United States Patent 11,781,116 (MAMMALIAN CELLS FOR PRODUCING ADENO-ASSOCIATED VIRUSES) - sequence listing, part 3

SEQ ID NO: 36 - DNA, 1106488 bp, Cricetulus griseus
  modified_base (163)..(2934): a, c, t, g, unknown or other
  modified_base (8456)..(8619): a, c, t, g, unknown or other
  modified_base (15799)..(16086): a, c, t, g, unknown or other
  modified_base (17737)..(17967): a, c, t, g, unknown or other
  modified_base (20752)..(27272): a, c, t, g, unknown or other
  modified_base (37964)..(37993): a, c, t, g, unknown or other
  modified_base (39955)..(39964): a, c, t, g, unknown or other
  modified_base (45054)..(45065): a, c, t, g, unknown or other
  modified_base (49093)..(49166): a, c, t, g, unknown or other
  modified_base (56967)..(58551): a, c, t, g, unknown or other
  modified_base (60598)..(60676): a, c, t, g, unknown or other
  modified_base (63030)..(63997): a, c, t, g, unknown or other
  modified_base (83605)..(83705): a, c, t, g, unknown or other
  modified_base (91044)..(91277): a, c, t, g, unknown or other
  modified_base (91962)..(92175): a, c, t, g, unknown or other
  modified_base (102066)..(102082): a, c, t, g, unknown or other
  modified_base (114085)..(114381): a, c, t, g, unknown or other
  modified_base (125782)..(125791): a, c, t, g, unknown or other
  modified_base (128879)..(128888): a, c, t, g, unknown or other
  modified_base (137854)..(137874): a, c, t, g, unknown or other
  modified_base (151312)..(151323): a, c, t, g, unknown or other
  modified_base (154767)..(155281): a, c, t, g, unknown or other
  modified_base (155764)..(155776): a, c, t, g, unknown or other
  modified_base (164226)..(164392): a, c, t, g, unknown or other
  modified_base (166478)..(166507): a, c, t, g, unknown or other
  modified_base (168031)..(168330): a, c, t, g, unknown or other
  modified_base (168496)..(168698): a, c, t, g, unknown or other
  modified_base (169262)..(169508): a, c, t, g, unknown or other
  modified_base (170999)..(171107): a, c, t, g, unknown or other
  modified_base (173262)..(173553): a, c, t, g, unknown or other
  modified_base (177094)..(177168): a, c, t, g, unknown or other
  modified_base (203588)..(204814): a, c, t, g, unknown or other
  modified_base (207834)..(207861): a, c, t, g, unknown or other
  modified_base (213726)..(213749): a, c, t, g, unknown or other
  modified_base (224899)..(224915): a, c, t, g, unknown or other
  modified_base (228923)..(229151): a, c, t, g, unknown or other
  modified_base (236770)..(238782): a, c, t, g, unknown or other
  modified_base (239121)..(239607): a, c, t, g, unknown or other
  modified_base (256938)..(257035): a, c, t, g, unknown or other
  modified_base (284119)..(284128): a, c, t, g, unknown or other
  modified_base (284653)..(284698): a, c, t, g, unknown or other
  modified_base (285740)..(285769): a, c, t, g, unknown or other
  modified_base (287241)..(287251): a, c, t, g, unknown or other
  modified_base (287405)..(288527): a, c, t, g, unknown or other
  modified_base (298519)..(298620): a, c, t, g, unknown or other
  modified_base (299355)..(299364): a, c, t, g, unknown or other
  modified_base (299654)..(299696): a, c, t, g, unknown or other
  modified_base (306689)..(306712): a, c, t, g, unknown or other
  modified_base (327237)..(327305): a, c, t, g, unknown or other
  modified_base (339484)..(342669): a, c, t, g, unknown or other
  modified_base (346468)..(346737): a, c, t, g, unknown or other
  modified_base (352957)..(355119): a, c, t, g, unknown or other
  modified_base (355338)..(355354): a, c, t, g, unknown or other
  modified_base (357417)..(357713): a, c, t, g, unknown or other
  modified_base (367507)..(367803): a, c, t, g, unknown or other
  modified_base (372120)..(372133): a, c, t, g, unknown or other
  modified_base (380820)..(381165): a, c, t, g, unknown or other
  modified_base (386188)..(386311): a, c, t, g, unknown or other
  modified_base (391630)..(392473): a, c, t, g, unknown or other
  modified_base (396265)..(396347): a, c, t, g, unknown or other
  modified_base (405204)..(405213): a, c, t, g, unknown or other
  modified_base (406456)..(406490): a, c, t, g, unknown or other
  modified_base (426332)..(426396): a, c, t, g, unknown or other
  modified_base (429687)..(429853): a, c, t, g, unknown or other
  modified_base (451665)..(451674): a, c, t, g, unknown or other
  modified_base (453243)..(454085): a, c, t, g, unknown or other
  modified_base (463496)..(463579): a, c, t, g, unknown or other
  modified_base (467188)..(467263): a, c, t, g, unknown or other
  modified_base (468482)..(468500): a, c, t, g, unknown or other
  modified_base (471330)..(471358): a, c, t, g, unknown or other
  modified_base (481369)..(481668): a, c, t, g, unknown or other
  modified_base (514369)..(514378): a, c, t, g, unknown or other
  modified_base (531263)..(531311): a, c, t, g, unknown or other
  modified_base (532671)..(532680): a, c, t, g, unknown or other
  modified_base (540039)..(540096): a, c, t, g, unknown or other
  modified_base (563363)..(563509): a, c, t, g, unknown or other
  modified_base (570346)..(570449): a, c, t, g, unknown or other
  modified_base (576914)..(576935): a, c, t, g, unknown or other
  modified_base (583216)..(583455): a, c, t, g, unknown or other
  modified_base (587012)..(587064): a, c, t, g, unknown or other
  modified_base (588808)..(588817): a, c, t, g, unknown or other
  modified_base (599898)..(600107): a, c, t, g, unknown or other
  modified_base (601781)..(601794): a, c, t, g, unknown or other
  modified_base (626592)..(626694): a, c, t, g, unknown or other
  modified_base (627375)..(627402): a, c, t, g, unknown or other
  modified_base (630111)..(630386): a, c, t, g, unknown or other
  modified_base (630497)..(630577): a, c, t, g, unknown or other
  modified_base (639423)..(639434): a, c, t, g, unknown or other
  modified_base (640127)..(640178): a, c, t, g, unknown or other
  modified_base (648355)..(648600): a, c, t, g, unknown or other
  modified_base (652544)..(652712): a, c, t, g, unknown or other
  modified_base (652832)..(652925): a, c, t, g, unknown or other
  modified_base (657027)..(657090): a, c, t, g, unknown or other
  modified_base (667667)..(667725): a, c, t, g, unknown or other
  modified_base (673937)..(679924): a, c, t, g, unknown or other
  modified_base (680407)..(680434): a, c, t, g, unknown or other
  modified_base (682238)..(682269): a, c, t, g, unknown or other
  modified_base (687994)..(688042): a, c, t, g, unknown or other
  modified_base (688933)..(688947): a, c, t, g, unknown or other
  modified_base (726129)..(732038): a, c, t, g, unknown or other
  modified_base (733080)..(733117): a, c, t, g, unknown or other
  modified_base (741290)..(741344): a, c, t, g, unknown or other
  modified_base (743839)..(743848): a, c, t, g, unknown or other
  modified_base (745514)..(745993): a, c, t, g, unknown or other
  modified_base (746600)..(746715): a, c, t, g, unknown or other
  modified_base (752952)..(753022): a, c, t, g, unknown or other
  modified_base (753229)..(753544): a, c, t, g, unknown or other
  modified_base (758531)..(758792): a, c, t, g, unknown or other
  modified_base (762510)..(762615): a, c, t, g, unknown or other
  modified_base (766174)..(766183): a, c, t, g, unknown or other
  modified_base (767768)..(767797): a, c, t, g, unknown or other
  modified_base (780681)..(780790): a, c, t, g, unknown or other
  modified_base (784763)..(785306): a, c, t, g, unknown or other
  modified_base (786027)..(787582): a, c, t, g, unknown or other
  modified_base (788669)..(788854): a, c, t, g, unknown or other
  modified_base (795841)..(796531): a, c, t, g, unknown or other
  modified_base (796746)..(796851): a, c, t, g, unknown or other
  modified_base (804219)..(804556): a, c, t, g, unknown or other
  modified_base (807151)..(807255): a, c, t, g, unknown or other
  modified_base (810281)..(810290): a, c, t, g, unknown or other
  modified_base (822028)..(822048): a, c, t, g, unknown or other
  modified_base (826291)..(826491): a, c, t, g, unknown or other
  modified_base (833673)..(833693): a, c, t, g, unknown or other
  modified_base (840225)..(841208): a, c, t, g, unknown or other
  modified_base (855872)..(855898): a, c, t, g, unknown or other
  modified_base (858677)..(858686): a, c, t, g, unknown or other
  modified_base (859302)..(859311): a, c, t, g, unknown or other
  modified_base (863211)..(863710): a, c, t, g, unknown or other
  modified_base (863884)..(863905): a, c, t, g, unknown or other
  modified_base (870189)..(870278): a, c, t, g, unknown or other
  modified_base (872829)..(873849): a, c, t, g, unknown or other
  modified_base (874702)..(874712): a, c, t, g, unknown or other
  modified_base (884202)..(884635): a, c, t, g, unknown or other
  modified_base (886013)..(886235): a, c, t, g, unknown or other
  modified_base (886558)..(886567): a, c, t, g, unknown or other
  modified_base (888090)..(888099): a, c, t, g, unknown or other
  modified_base (892953)..(893193): a, c, t, g, unknown or other
  modified_base (895232)..(895241): a, c, t, g, unknown or other
  modified_base (895747)..(895800): a, c, t, g, unknown or other
  modified_base (914130)..(914235): a, c, t, g, unknown or other
  modified_base (925901)..(925934): a, c, t, g, unknown or other
  modified_base (942110)..(942909): a, c, t, g, unknown or other
  modified_base (943570)..(948256): a, c, t, g, unknown or other
  modified_base (952040)..(952241): a, c, t, g, unknown or other
  modified_base (954347)..(956856): a, c, t, g, unknown or other
  modified_base (962027)..(964193): a, c, t, g, unknown or other
  modified_base (964736)..(967224): a, c, t, g, unknown or other
  modified_base (967888)..(968702): a, c, t, g, unknown or other
  modified_base (969900)..(972329): a, c, t, g, unknown or other
  modified_base (976998)..(979487): a, c, t, g, unknown or other
  modified_base (982285)..(989211): a, c, t, g, unknown or other
  modified_base (1001164)..(1003286): a, c, t, g, unknown or other
  modified_base (1028002)..(1032268): a, c, t, g, unknown or other
  modified_base (1033965)..(1034830): a, c, t, g, unknown or other
  modified_base (1042537)..(1047439): a, c, t, g, unknown or other
  modified_base (1074169)..(1080307): a, c, t, g, unknown or other
  modified_base (1090242)..(1090530): a, c, t, g, unknown or other
ctagatttccttttttaaccataaaaatttagtaagacctgtatcctcttgaaggaaccagcttccttttggcagccataacagccgaacacgtacttgccataaatctgccatggtcacgtagaggtcagatgcctgtctcgtgacaaggaacccatcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctggagccgcacgtttgggcgccacctgccccggccctcggggctccggtaattcctgagtccaaggtggatcacgcctgcaaataatgggcaagaaagaaagagcgggacccagcagcagagaaaaaggaagtggggggagggatgagttcattctggtcaggcagggattctgaatctcctgtgtttatctcaggcactaactaaggaaatgggagaggggataggtgttagttgcttctcaggcagatatccggaatctcctgtgataagctagactttctggcatctaactaggtatggggtcgccaaggctggcttctgacaccttagaaagttggtctcctgcagtcttattaggtaaggctttccatgcttgaccagcagccactgagatctgtgcatatacagcagggtcataaagaatctgctggcctagacctacataggctcccctgccagtaagcatttctaagttccttcaaagaaaaccagcagctgtgttgtgctgcactgtttgattacaaagttcttggtattcacccctccagatcaagtaatctccccctgatagcgtagctctacataattgctgccagtcactgggggtgcaattcaaggccgaaaaagattcaaaaatatccagagtaaaaggggcatgaggcctgtatgccacaactgcctcctttagttgttttatatccttaaaagttaagcggggcatgctctctctgactctggccttggggattaattgtctctataactgggaatatcactccacccctctgctcttcaggaggggctgaaggaagacagagagagctagaatgctcgggattatgagcagggggacgtggctcaagggaacatctcctaagcttaggctttaatttgaggatgtccttcttgaattgaagtgcttcaccctccttagtctcatcccctgaagagtagagagagaactcagaggaagaaacatcagaagcttggagtgacataacagacagatctttgtcctgagcctctgcaaaagcagctttggcttcctcaacctgctctttcacctccacattatcactaagaagtgcttccttgacttgacgccacagagaaaaagtaacaattgatatggcatcttccccttctttttgtaatatccttagtgggtctcccttcacctgctcccaatcagggatattaaagtcaccaaacaccaaaaaccaagggctgacctcatgttcagttttcaagaagccttttgctgtcttatgtttgataccggtgccctgcttttttaacaattggaccagttggtcccccataagagagtaagaactagcagcacccatattcaatacacccactccttacctttttgaaaatgctggccagctttcatgggtgattcttcagtgtcttcccttcttccccatctcggtgaaatctccacttgtagtgcctgcactacaacacttccacagtatagggcaagggacttgaggatttaaataaagacaagacagcagatctttcttgcagggagagaatgctctctattccaacaagagtgggggcttatataccagtcagcagggatggtggaaaactacccagataacaagttcaggttcccaggcccatcaggcaatcctgaatgggtgaacaacaggacaacaggaacttgcactcaggccttcaaggaaggaagaaaacaggatgtaactgctaggtaagctcctagtcacaagctggtaagcagacccctatgggggaagggcccaacacccatgggccgggacaaagtgcatgattttcttcagcaataagttcttactgtctaccagttggggtgagggtagaccaaggacaatagcaatagcctataacagccttgaccaacaactcaaaagagaccttctcatgcctggtgttgggatttttattagtctttggttcttagagggaccactgtcagcccactgggaaaatttcatttaaattatatatgtgtgtttatacacagacttacatgttttataggtttgtttgggttctttttaaatagatagttaatagtaccttataaaattttcagacatcattactgttattttaacctcctatcttcttcttctgtatttagttcctctgccctaagtagagtccccattgttaggtcttaagtgagccctaaaaatggcagtgctgctgtcctaagttgggtaaacagacagattgttattggataaacagaaaactaggctcacattcccctgagttcttgtaaggtgggattctgtttaccaggaaattcaataccaccctgatccacctccaaaagggcatctagttcctgattagaccaaaaaagcctgcaacagttcaatgtcttcatgctaaccccaagactactatgattcatgagtcttctaccactataaccttcccaacaaaactgacaaggcttttccctatggctgctgtcctctattcttggagaccacctggtcatttgttccctcaagaaacttgtcattttacccacaaacagacagatggtttgtggtttcactgaaccttcatttacagccattttcccaatgcttggttaaggttactattgctgtgatgaaacaccatgaccaaaaccaaattggggaagaaaaggtttattttgctcacagttccatttatagttcatcatccaaaggagtgatagcaagaaatcatgcagggcaggagctgatgaactggccatggaggggtgctgcttactggcttattcatcatagcttactcaacattttgtttctttttcagtgctcttaagatttatttattgtgtatacagtgctctgtctgaatatatcacaggccataagagagtaccagatcacattacagatgtttatgagccaccatgtggtttatgtgaattgaactcaggacctccagtagagcagccagtgcacttaacctctgagacatctcttcagtcccatccttttttatagaatccagaactactagcccagggatagcaccacctataatgggctgggccctcccccgtcaaacactaattaagaaaatgccctacagacttacctatagccagatcttgtggaggcatttttctaaattgacttaatgactttagcttgtatcaacttgccataaaactatctagcacaatgttacgataaatctttctgtcaccagcttgagttctgcctgccacatgggtggccaaaataatacacagagacttatattaggtacaaatgctgcttggccaatgactaggatttctcacctgctagctcattcttaattatcataaatctatatattttataagacttatcttattggacgccagtggcaagcatcctgtattcctgggctcatctgatgactctggaggaagagagaaggggcccaattccttcttgcccttgtatttatttatttatttatttttggttttttgagacagggtttctctgtgtagctttggagcctatcctggcactcgctctggagaccaggctggcctcaaactcacagagatctgcctgcctctgtctcctgagttctgggattaaaggtgtgtgccactaatgcccagctcttgcccttgtttagatgagtctccctgctatgtcatttcctgcctggatcaccacttctttactacattttccagaatcctacttgactcctagtcccgcctaatgtgctgcctcattggccaaacagtactttatttatcatccaataagacaagcacacagatgcacttccctcatcatctcctcttttctttctaaataaaaagaaggataacttaccttttataataactgaagaaaactataatcataactatctgtcttcaactccatcaaaggccacagaaggatagcatataaactctagaattgacagagatatcttgctacctggacagtcaccccagatgcacttccctcatcatctcctcttttctttctaaataaaaagaaggataacttaccttttataataactgaagaaaactataatcataactatctgtcttcaactccatcaaaggccacagaaggatagcatataaactctagaattgacagagatatcttgctacctggacagtcacccaaagatcctctataacgttggggcatccataggccatagtgtgtctggactcttctccatttccaacaggatcccttcaggactgtcttgttttgtaagttcagcagtcactttcttgtgggtcctgcatgtccagtttatacagcaacaaacagtccaggcaagagcagtttcttgcccaaatggctaatcttgccatgttgaaagcaaactccataacgagtttcttcgttatccacccttctttctgacgtaattggtgtgctaggagcaattgtgtctcactgccaagaaaacactaaaccatttaaatgccatattttctgtaggtctttgaaaggtttgaagaaaacctattcatctcaaatacatctctgtatatctagaaaacctaactaacctaattataagttctgactattataggtaactatataacatgtatttaattatgcatatcattttaaaagatctgtataaacataatacctaaacaagaggagacgtatacatatcacaaaattgaccttaacgttgtatcaataaatgaaaatccatactccggctccacaaagtattcattcttatatcctatttccccctttttttgttttaaaaaagagattgactatgctcattaccgtttataaccaaccccatttaaatgaaagcaatttataaacaatatttgggaatttgggcgtcattcattccaaactgcttcctgctgattgggggcatgtccataccatggggatcatgataaaacacagaaatctgaccaagtccttgtttttgtagtctgcaaggctgcatcgtctcagctgttttgaatgtaggataagttgggtcactgcttcaaggggtcttacttgatcaaaccacatttgtctggaaggaatccacagcttttcattttctgtggaaacacaagcaaaaacttttttcccaagtagcctgtccttagacttaaattttgaagtcaaagcatttttaaaatatataagttgtattaatttagcagcacttataatcaaatgtattttagcagcagtaactctttccttggcaatcaaacaatttaaagataacaatagcaaatagtatccaaactctctgtgtatttttcatctttaggtggcttcctgataatacaaaattagctttactgtttatacaattacaggaaacaatcagaaacagaagtaatcctctatacattacacatgttggatcccatgcaggtctgccaggcaaactaacacaaggcaatgataaaattgatcattgattaattggaagtgtgctagaagcctcagaatttcataagaaacatcatgtaaatagcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcttcttagtctccccattctgccttataataaacttatagtcttaagtctcatgtctcagcaatttctcttttcttctttttaaacaaggccaattcagttattacacacctgctagaggtgatggcagttatgggtatatctgcacaaataaaaactgacaatcctccagcatatgtctccacaaaattggaacagtttttcaaatattataacataaagcatgtcactggtataccacacaatcctatggggcaagcagtggttgagagatctaatagaacacttaaggagatgctccatagtcaggctgggaaaacaaacccccaaacacaggttgcataatgctttactaacactaaactttcttaatgccgatgagaaaagacaaacagctgcagaaagacactggactatggaaaaaactgctgaactgaatcagctagtatacttcaaagatgtactaacctctgtatggaaaccaggacatgtgttacattggggtcggggttttgcattggtttccacaagagaagaaaaactttggataccatcaaagttgttcaagattcgagttgaaaaggaaaaacctctcgatgaggagaaatgataggtattctactaaggtatatttcataaactaaatagtaatctcccttaatgaaagagaagtgttttgtttttatcttcacaggaaaactcatctccagaagtcaaaggacacttcatggatagatacataagaagagaaggtagctataaccagcaaacaaaaggaacatgccatacagtaaactttatagctgtctctcagagaactctatttctctttatttcctagtccctattcaattaaatcaatgctggatttagaggtgaatttggctttcctcctctaaaatccaagcacattctttaactaaactttagagtttctgtattatatcaagaataagggaagaatttgggaacagtctttgtcttttcttggctctttccttcaaggtgtataccctctcataattattattttctcatgattgcctttcctggtatgcatacatatacaagtaaacatttctctgctaacatttatgtttgagtcccacacagccaatgaagacccacctgacagcaatccctggatgctctggaaaagaaattgggccatacctcctcgactgcactggatccaacttactccatttcaactgacacattcattctgttatattgttaatatttgtacttaaatcaaaagagctaaaatttaagatcacagccataagttccatatgttaataaaaagtttgagctgtttatttcttatactacagtaagacaatgacccaagtttaacaaagggcttaaaataactgctaaccccatgggtctcaattctttagagttttaaaaacaaaactcctttataagggtagcctaggaccacctgtatgtcaaatgtttacattgataacaacaaaaaattttaaaaacttaaaacatcaaatttttaaaggtaaacctgacaatataaagtcttagttttataaaagctgataacctgttacaagatgttaaaaaaatacaagttactagccattcttataaattaacaagtagccagacttacctaggcagacttctaatactacaaagatctgcagaatatggcatttaaaatgttaactaaaaagtttataatatcagacagagaattccaattccagatcctgacagtgacccaaggtctctaaagaagattatggggctccatagattgtgacaatgctgaccattgagcataaagctcagatactatacctactaccaggcaggactgggctcagagtgtggacaggctacagaacactggagaattgattgcaccacctttgcctagacaaaataaggtcagtcttttccatgtccctcttccacagagagaaaaaactctcattttaaggacctggcaaagatttacttctgtccccaacactattgagacttgagtatggctaactttacgtggaccaaggggggggggttggtttttgagacagggtttctctgtgtagctttggagactatcctggtgctcgctccggagaccaggctggcctcaaactcacagaaatctgcctgcctctgcctccccagtgctgagattaaaggcgtgcaccaccaacgcctggttgcttctttatttatacataattcattaagaagggatgtattcatgttgttctaaaatatagatggtatcgattctgattttggacatgtgtttgacttcctcttacatatctctcagtcatcattgataaactgtggcaaaacagtgttatcttttacaatcgttttttactcatcaaccccataactaaacttttaagactctagaggcatatgacagcctattcccaggctggcaactcttgaggattcaaggacactagacagaaagaaaatctccaagccagcccaagtagatttccatgtcctgagcaatgtattattaactattaatgattagagtgtcaatagtcccaagaaaaattctcaggccaaagctgctgcagttactattcagtaacaactatattttatatctttatagaatttatttacatgtctaatcctggcattcttttgttgcttggtcatatgacaccacgttggctctgcaggagttaagaaactaacttttcgaagaaagggaggtcctgacacctcattctttgttttgttgtgttcaaattctgaacccccaaatcaccaagagatccattctgatgcaaaagcaaaagatcttttattatttaaccagttaactgtcttaacttggttctctcatctgtccaacacagcagttggtgtgagaaggacccaaaggggccaaaggcagggaaattattggggagaacaaggggagtgtctaggggtacacaacagtctcaagactggtgcacttctgggtttgggggacttctcctatgttgattggttaactggttgttatggcctataggccctcccagggtggttgctatgcacatcactgttattccacttttactgtaaagcatgtccagagcctgccagctaacttctgattggtttcttgccacatggagggtatctgacctcctagtgactagggcagttccaacaaggtcagaagggtggaaatttagcaacatgtgctgaatcagaggcctacatgttgctgggtcttttctgcagcctgtcatggctgttaaagcagggggatgggtaagttgtctggtcccttcagcttgtttatttggttggtttgctttgctttttgagacagggtttctctgtagctttggaggctgtcctggaactcattcagtagactagactagccttgaactcagagatctgcctgtctctacctacacagtgttgggttgccaccactacctggcaacacttcattcttttattgtctttccataccattccttgcctgtcaatataaggccctgtgtaggacacaggtaacttcatctcatctatctttgttgctgtatatgccacataattgcctgagtgtatagtaggaaaagacttgtaatctgatctgtagccatctcctctagcctagtgaatcctgttgacctttttaagttcactttgctttgattatcttgttcctgagtaagtgttgtagcagatattttaagagtatctcagagactaataaagagatctttggatgttttgtggggagtttgagacaaggtatctctgtgtatctctggctgtccaggaattcactctgtagactaggctggcctcaagatttgtctgtctctgcctccagagtgctaggattaaaggcatgcgatatcactggctgactgatctctggcttctttatgtgcatcacaaccttcaaggcattaaggaagatcttcaagtagataagaatatctccctaaaagtgataggggttgtgtgcttaggactttcctgagaaaattaaaagcataatgaacaaatataaaaagcccctccagtatgcaacctgcagagaacaaaatgaaaagtgaaagacagtcacagcagcgatcgtgtggctcagcttttctgggtctttgtcactcagctgtgctggctttatgatttttgccattcctataagatatggctgtatcaccacatcatagattttgatgaaaaaataacataaaccaggcagtggtgatgcatacctttaatcccagcacttgggaggtaaaggctggtggatctttgtgagtttgaggccagcctggtctacaatgcaagttccaggacagctagaactgttacacagagaaactctgtctggggttcagaggaggaacattataaatgaaaatgttctcctccatcaagtatgtgagatatgacacattagtgacagcccaacagataaaggtatgctggtcaatgaaacatcagacaatggagtccaggtgtgtgcaaccatttgtaggatgtccaatgaattggaaccaagcatccagggagtctcccaatgaccctgcaagcactgtgcagaccttggaactgttctgtcacattggcaacagtggcccactgcaatgtggcctgctttatgtggcagctgatgggtgatgggaagaaagtcaattccctggcagacagccaaatccttccaagcaagttcaagccaggaagtgctggccaacttatcagtgttggaaggaaggagacagctgaggttcactcactgcagtgcattggagcccatatgactactgtgccaggtggccacagcaagtgacactaccctgaaaggctgggacacatggaatatgaaccagatatactgcttagagaacatctatgggcagcttgtgtgttgaccttgacttcaatgccaacaaacagtattatctcaccagctgcagaagtgactacaaagtaaagttctgggacacatggaatgccacttagcccatgaagaccttataagatcactcttactgggtatggagcatctgctacaatccctctcatgactagctagctggtcctcactgacagcagggtcagcagtgtcttcctgtttaacaaggtgtctatttcctctggtgtataatcatgatgtcatcacacacacacacacacacacacacacacacacacacacacacacacgctgagaagtgtaaggaacccttgcgggacaatattattgccacttttgaggcacacgaagacagtatgtaccctttggattgggcctcagatgacctaaggctgttttcttccctgagttgtgacaggaggccaattatcaacagagtcccaaagcacttaaatatcacatactgctctggcggcccatggtactgctgattggtacttggcagattctcagaaatctgcagctgtgagataattccctttgtagacagatccctctatgggagaaccaacattgcttccaacaggagctctaggggaaacagctgagcttctaccggaggctcagctgaagttgtcatcactgtgaagaatctgcctaactccattttgaaagcaggagacattatgctgcattgttaaaaataaatttctattattgtaagagttgagttgctctctgtttcccggaacctgactttacccaaccgatgaccttgacttgcttttgaggatagtcttaccctccctagacgctcccaaattgcatggtgatcatatgatttttttaaagattttttttgtatttccttattgtcctattgtctcccatctataaactactcatgattttactccttaaaaggggcccaagacatggattctaggctgctctctttaacccagcttaggaggcaatagttagccagatcttgcatgtaccccaataaaaaaaatcaagcttacctcaaatttgactcaaattgtgacggtggtcttattcttgcctttggaattagcattttctggagagccccagtgagattcaaaccacccaccaaaattctaaacctggaccttcaccctggaactccaaaaggctaggagagctacctcaggaggcacatgccttaagatgttccaaggctgcaagactgccttcagttctagtaatatagggtaaactttcatgctgagaaatgcagcaagcatcaatggaggcctcctggtgagttacagtctggttctgttttgtgggattcctacctaggatgtggaatctccctttctctgccagagatctctataactggaagaaccagaactcacctttcagcactagccccaagtacttagtttctctaatactgtctttaaaatcatttccctacatgagacgacagtcagcagattctctgtaccctctttgttgttcttttgtttaaattacattgtgtgatcaagatggaacatgaaccaagagattcattaaccatgaagtttattaaaggggggagcaagaagggagtgaagatagagagaaagagggggacaaaagacgagagaggagggggcaaaaggagaggaaagagcagaaagagaggagagctggaaagagcagaagcatgtaagtgggccggggtctgtcttttaaaggggtcctttgtacctgcttgcagactagtactcatggaaccctggattgaccaggctactgcctgagtgcattctgccaggtgacaggggcaggcctgtaaggagccgttacatatcccccttttttattaattaatgataaggcttcttatttttacaagcaagtaggtcacccatacattgagggatagagacagaggttgtacctcccaaatcatacaataagactgtgtacgagagtcaccactaggctgttagcttgacccaaagcgctctcgacctatcctccgccgtttttctgggaaagggaaactggggcaggcaacccttatgcaggacaacatgcctcccagagaagcctgcatattaggcaactctctgtgcgatgctttgctcgacatccctcatgggctgctcaagccagacaccctactctgtgcaatgagcctaggctccgggtgtccaagagctgtctggccggtggcctattgcttaagcattgctaaccaaatgtcagtggaagccccttgttccaaggctacaagcgcttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggttcattttccataatatgtccaattgtttgtttttttgtttttttttttttctgccctcaaagacaggaaaagcgaggcacagctttctttttaccttttctggaagaaaggaataagacttcaggcgcgtctcatagggagggggcgccgaaggagcaacctgtgagagggctgtttgaagctgccgtcttcgaagttttttgctactttgtatatggtcatccagatggtatctttctttctcatatttagcagcttcctcacctagctcagcttctaagacttcatctcctgagctttcagagtcatcagagctatcaagatttaaggcttcaagctcatgtacaggatctgacaaatacactcccttgtcattagacacactgggaggtcctttttcattttttattgccgttttgtttcttgcatacactcccttgtcattagacacccggggaggtcctttttccttttttgttgccttttcttttcttacatacagccagtcagagagtaacacttccgaggcggcggttgccagcctatataagggatgggtttttgggagttcagagtctccactctgtaagcttatgctctccctctcaagacgcattaaagctttactgcagaaggatcctgaggagtgtgccgcatcatttttgctggcgagtcggttagcgcgggacacaggccagcataatttgcctgaattcttacattcccacctttacttattattaaaaaggtgaagagtccagcatggcagattagggataaggacaccgagttctcaagactacttcctgctgatctggggggagttgaccatctttgggtgacccaagaaagcatcctgttttctagtcctggattacagccctagccataccccactggcataaaaaacacaagctcttacacctgaggtttttccactatgttgtaagtctgtatataaggatgctccctccctgcaaaagagacagaggtccacacacattctcctagcacaaacaaccagacatctctgcttttaactaaatcttcaagctttaccccaataccttggacttgctcgtggggtgggcgccacaagggaggacaaggttaagtttagagaaaaaaattcttagatccggtacttgaagggaggattgtaagattagggaggagttccccagggggtcccaagatgagggaagggagtcccaggaccagggaaaggttgaataatatctggagtgaatctgacctgtttgggtgggtccaattcagctccctagaacttacaagaatcctttgagtttgtgaaaacataaattttagacatattagcagtatactcatgtcagaaatgatttggctaaaacattaacacttttaaaactgacagatatctttagaacaatgaaaagcaccttaatcttgagcttgtagatacagttatgatggcataatatggtgtttagtactctgtcagagttggattagtagcttatcagaactgtatttgaagggaccagccccccttttcggcagccatgatagtaacacgtgctcgctatgaccttgccttagtcactagaggttaggtgcctgcctcgtgacaaggaaccaatcagaagttagctggtggtgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctctgtgtctcatttgaaccatccaatagaaatgattctgtatttcgcctcatttgaaagactctgtgtttcacctcatttgaataactctgtactgcgcctcatttgaataaccctgtatagcgcctcatttacattgaccaatgggaatagctctgtacaatgcctcattagaattatccaatagaatccctgcttctaacttgcgcccttttccctatataaggacccctttcccttggctcggcgcgcttggcctcacagaagctaagtcgcccgggtacccgtatctccaataaagcctcttgcggttttgcatccaagttcgtggtttcgctgattcctgggtgtgggtctccttctacgaaagtacctcttcgggggtctttcacttttcgactctgggtgtgctttacggataagcgcacagcaatgacatgcagagcacagcaaccaccctgggagggcctatgggccataacaaccaattgaccaatcaacacagggcaagccctctaagcctggaggcacaccaatcctgagtctgtgcatacctgtagacacttccccttacactgccctacaagattgctcggcagctggttcaaggggtctttgctagtcatccaccacggtgggtgggtgaaagacccgagctaacatggggttagctcattaaaaaccaataaagcctcatgcagtttgcatcaagctctcgaatctgcctggtgattggggtgacctcggtcgtggcctgggaccccagatatctgagtttttccgggggtctaacaattgactaacgttaagactatgaacaatagcataaatgagaaaggaatctgataacttgcatttgtacaccttaagtaagcttgttataccttaaaactttttttttaaaacaaagaaatgataagaagttatactgaaaccagcagccgtcaaactgcatcagagttcttgagaagggtgaaattttacctgaattaattattacagaatgagcgagactggctatctggccacatggacagccacctccaaggtcctctatagttgttgagggcagaggctttaaggacacctgccttctgctgatagcatgagacctgtggattaggagctgtaggaagacttgcctaccattggcccaagcaactggagaaagtaatttacactgtcctcttggccacagtccaaagaatcctttgcagcaattgaggtgaaaggcaagattgctcggtggctaacgttaccacttttgtgggtggagtttcttcagtgtccagtgtttggaggaaatgggctgatgccagcagttggcctgtctcgctgttataaaaagcttttaaataaaacattttaaatgccatattctctagatctctgagcatttcagggctgtttgtctgtttagtatatctcagcagacaaaatttgtctttagttacttgccttaagcacatagatggctaggtaagactttatccttgtaattaatttgtatggctacagattagtatggctacaatgacattagggtaggatctgcctggagaactggaatgaagctgagaggctgtggaaggatgttttacttagagccctgtagcctgactgtaactggttttaacttagtgggttagatttacacttctaaaagacaaagaagtagagaaaagtccccttttgtaatagaagcttaaccttcgtaaactgtttacaggaaggactgggtggtataaatattttgttaatttaaaatagacctttataaccttaaatgtttaccatcatttaaagatacacaacaatttagaaatatttgagactgaaagaccccaactcaaacccaacctgatatctaccaacatgtatttgaaaatcaccctggccacatatacacagctctggggaaaaataacacatgaaatggtcagtcatgatgaccagtctcttgacccgtccagcaggccaggttattcgcgggtctcgagggggttgtcacctaaaggggtcatgagggcgagagaggaggagaccaagcggcgcaagaaaggacaagagtccgtctgtgcaatgtcaaggtctcgtttattgaaaggtaaagcttgcttatatgcaggggatttttactcagggcggggtaagggagcaggaggaatggaaaattttcaagaggaaatagaggcgaggtaaatcttagcccatggtcccattgttagcgaaccgcagctatttctgagaaaagggagaacattttgcaacatgtattgtgcagcttaaccggaaaaaacatcttgtagtcgaagcgattctggtcatctaacaatgattaactcttgattcagtatgaggccccttttggccttcgacatctcccccttctgtatacaaaaagggatgatgaatcttattatcaagagagcccctgtcttaggccgcataggctgcgcccctggacaggcaacgtgccttgttgagccggtcttgacgacctctgtacgttgttgccccctgttccaggacctatgcatactcccgtcattgagtactcccttgctgcatcaatcttgagttattaaccctgagtccttgattactgaacctgagctcttgctgcgaccctcgctcctcccccgggtcagctgctactaatttgtggtaatggaccgaaatacttttaggtaaggccgaatcaatttgtcttttaataagctgggttagccgttgaagggcccatgggccaaaagaaagaagcaataggaaaacaattaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggcgccacttgacccgtccagcaggccaggttattcgcgggtctcgagggggttgtcacctaaaggggtcatgagggcgagagaggaggagaccaagcggcgcaagaaaggacaagagtccgtctgtgcaatgtcaaggtctcgtttattgaaaggtaaagcttgcttatatgcaggggatttttactcagggcggggtaagggagcaggaggaatggaaaattttcaagaggaaatagaggcgaggtaaatcttagcccatggtcccattgttagcgaaccgcagctatttctgagaaaagggagaacattttgcaacatgtattgtgcagcttaaccggaaaaaacatcttgtagtcgaagcgattctggtcatctaacaatgattaactcttgattcagtatgaggccccttttggccttcgacagtctctggaaattgttatttgtcaggagccagccctggtcagatataaaagtctcctttacaagaggcctgacgacctccatgctcagctaaccaccaattagtcaagtacctcccctcttaggttctgggacacctgccctggcctgagagcaattaacacccattcctcccccacttcctctttctttacttcctcctttctctttaaaaaccccttgtttataatcaataaaattagaccttgacaaggacactgcttggtctcgattctctttcttgcccatttattttcaggctttgtccccctcggacccatgaattaccagaaccccgcaggcccgggcagttattattactagtttccaaggaatgttgtagggagccgtccctgtattctccattacaagatggcgcctgcatccggcaggcaccgaatgtaaacaagttattgcgcaggcgctgggtaactttctattccttggtctctgcctattccgtggcgtcatatggcccgatgagctgcagccaatcatggggtgacacgtccgaggcggcggttgccagcctttattaggggacgggattcttggctcggggtctccgctctggtaagcttatgctctcctctcaagacgcattaaagctttactgcagaaggatccgaatgtcctgtgtggttcttgccggcacgactatcgcgcgggacagaatgttattatcctcaacaactgtctggtttctaaaaattgttatgggttaccctgctccagagagtcattactacccatgttttgagaataagtataagccactctgttcccggaaaaaaaacactagctgtcccatggtcttgcaaatgtaaaatccaaaataacattccaaacccctcgtaggcaaaattgtaagttcaattcccaaccaatcagtaaatgactcttgtatgttatagccaataaatatgttgttgtactcctgcctagtgaccaaaaagatataaaaactgcttgctttggaaactcggggtcaatctcagagaaagacgccaatgcattggaataaaatccttttgcttttgcatcgaacttgcatcctgtgagtgactttgtggggtgtgtctcccaaagttgaaccccactttgggcccaacaggacttagaacagttgaatttaagttgcatatagagttagcttacatttttgaacagtagctacatgtatgcatacacatagatgtatttaacaggactgggtaaaagtaagaagaaccagagtatgatctctgattctcatgttgcagcaaacaggcagaacacttaaaggtacagagtagacttaaaacttccagtgacaagaaagaagatccgccacagatggaacaggcaaggtttttgtgtgaaatgtgtccctaccaagccctggaaaggcacgccattccacaaacaagccatgcgcaacagagccagtgaaagaagaaattagagacaaaaataaaaggcaaatgaattatgtctgtcagcagggtttgttggcagaagctggctagactgtccctctgcctaggctgagggaaaggagtaacccatggagtgggcaggcctacagctaggccacgtaatcaagatggctgcttctataaacatgttcccatctgacaaaagtttaactctcagagtgtcctgagcaaatgctgcctcaggccaggccactgtgagccgctggcatctgtatagaaaagaaacacactaggtcagccgagataggacaaacaggagagtgagagacattttgaacaggagcataagaggtctatgaaacaggacatttccaggtggaaggaggttcctgcccttagcagtcttagccatgatgggaagtggcaggatgccattgtggcaggcaagagagttttagtgaagggaccagccccctgtttttgcagctatgacaggttaacatgtgctcccctgtccttgctgggcctgtcctgctcagtaggaggtcagatgcctgcctcgtggcaaggaaccaatcagaagttagctagcagggctatgctttatggctctgggtgtgctttacagacaagtgcacagcagtgacgcgaagagcatagcaactgccctgggaaggcctatgggccataacaaccagttgaccaatcaacacagggcaggtcgtccaaacctggaagcacaccaatcctgagactgtgcatactcctaataaccccttacgctgccctataagatctctgtctcatggtttctccgggtctttccccagctgtggtggatggatgaaaggcccaagctcattaaacaacttcaataaaagactcgttgtttttgcatagatatgggcctcttggtgatttgggggttcagaatttggacacaacattagcatgctaagaagaggagggaaacagacaagtgaaaaagagcagaggacagactcccaactgtggatcactggtagaatgaagggtgccaataagcaggcacatgatttgatatagggggcccagcttccttgagagaggtagagagatccaaagcctataatctccagcatcccagagactaagggaggatcagatgcaaaaggcactgactgattttgaggtccattgagcacaaatcaggggtcagggctcccagagcccaacagatacatgatcatccagttctgggatttttggccggtccaaaaaggcaagagaccacagtctccatacaagtacaagtcctaattcctggttgcatgggcagaggtagaaaggaaggggcagccataccagattggtgaaacccacaaaaacagctgacctgaacaagggagagctcttggtccccagactgatagctgggaaaccagtatgggactgatccagaccccctgaatgtgggtgtcagtgaggagaccttggaaatctatgggggcctcaggtagtggatcagtacttatcccttgcataggaatggactttgggagcccatcccacaaggagggacactccctgagcctagacacaagggggttggcctaggccctatcccaaagaatatgatagactttgaagacctcctatgaaaggcatcacccaccgccatgggataggtaggttgttagttgggggccaggggaggagggagggagggagagggacctgggattgacatgtaaaataattttctttctaataaaaagaaaataaaaaaagaaaggaaggggcaaacctaccagacatggcagtggtggatagaagaatccagagatccttagttggaaaagtgaccaagttgaaggttacagggttcccagaatatctcagactgccacaagcaggaacagatgccaggaaaacctgccgagtcacgtgcaccaaaatgttgttcttttgtttaatttacatggtgcaatcacaatggaacatgaaccaagagattcattaaccatggagtttattaaatgggggtgagcaagagagggggatggagagagagacagatgaagagagagagggtgtgaaggggaagagaggagggagtaaaaggaacaagaaagcaaaaagagcagaaagagagcaagagcacgtaagtgggcaggggtctatcttttaaagaggtcctttgcacctgcttgcagactagtactagtactcatgaaaccctgggctgaccagagtactgcctgagtgtattctgccaggtgacaggggcagggcagcataatgcccaaatcttcactactgaagaaagggaaccaattctcatgaaagcaactgaagcaatcctagaatagcttcaatgctgatgaccagagggcagagataattgatcatgctctaccaagaaggagactccaatgggactatgacacagagtgaggtaggaagtcattcagtgaatagcaccaggttctgctagaaggggtgaagcaggcagccccaaagcccactaacctacttaagataacagagatgaaacaggacccagatgagtcaacttcagctttcctggagcaacccctggacacatattggtagctaagaaattaataacagaaattattcctaaatttggcctccccaaatctttgggatctgacaatggcctagctttcacacccaagttatcccaagtgatctctaaggctcataacataaatttgaaacttccttgtaagtatcattgtcagaagtcaacaaaagtagagaggatgaatagaactctaaaggggactacaactaaaaatactcaattgactttggatatgactatccctcaggtccagactgatttacctgttgggtacccttacctgatcaccatcccagcctggagaagttgtattaaaccaccacttcaaaactgaccaggttgaacctatatgaaaaggcccttacaccgtgattctccagaccctgactgctgttaaggaaatggtatttctgcctgcattaatcactcacacttcaagaagacacctgaggaacccacggaagaggatcccaattcccagagatggaaagtgaataaaaaaggaccattaaaaattaaacttttaaggtttcactgtctaacataactttgtgttcttgctgttgaaatttgcaccaagatgattgtcctataactacaattttgttgttttgtttcagcctatgcaaacagaacataaatgcatcttgacaggggaaacaaaaggatcccctaacataggaaacaccagatactgtcttgccatgcaaaaaattgactttgtctaccagggcccatagtttggacaaaaggagagtaaatattctttagccaaatggatggaggatactgggatggaataatctaactgaccaagtccaatgtaaaaacacaggcttcaacatagtcaaatattctttaaaggattctgataatggaaattacaggtgtgctaaaataaaaagaggaagggaggattcattaattacttcaattgaatttaacacacaaaatttcacttattcataaacaaatcaatatgagttgcttacaataaagacttaatgggttgtagagattactcagttgctggtagccatgtcagaggagcaacaggtaaaaattgaagttcgaggtgtcagcctaccaggaggcaaatccctgttgggtgattctcagataggcaaaccctctcctgccccacacccagccccccagaccacagactccagaatgtcttttgcttccactgttcctttatatgtttgctgctgccatctttctctggtatctggtatggtgggggggcggggtagatacccactgcctataatgtagtgtgtttatctcatggaacatcccattctactgggcatttttacctgtggattataatgaagaggatttcttcctaagcagtactgtctaattgataaaaataatgttagtttaaatagagtttgatgactaaaaataaatacaagaaattgtcatacaactagggcctatgagtgtcaccaaaggagatgcatagagggctattcaggttcatgattaaggaaagcaactgagtccccagggtggctcaaattcttttcaccttaatgttgggagatgtgctcacaggtttcagagtgtatcatagctgaaacaaagcttttaaaataaactaaggttggaatgagactttttcttttgttcaatagccttgaggtgaaaaacccaagaagacaatctaaagttttagaaaggtacatcattaagtgaggaaatctttaaggtcaggaaacaagaacaaagctacccaattatcattagctggggtgcctttcttcctaggattggttgatgaccaaagataatgattaatttcttataccttatacccatttttgccctcaatctcctgttatatatatttataatacctgttgatgagtgggtatacaccctaaagattttaaagtagtgctgactgtttttcctgtataaaagtctaggtttatgattcctttaagattccttataaaattacctttcaagataagcaataaagtgattggttctttctttgtaaccatgaagcctgccaataaaagaatgccttgcttgcctaaactgttaatctataacaagttgcttgggtatgaatgtgtgtgggttcttaggataacatgtcttgcacctgtaatacataaaatgtttaatcatgtacaggttttggaaaacacactgttttttacttgcattcattgtgattacattatttaaaaaatagaatgtaaccacattgtaatttttatattgcctgaaagatttttgctggggtatataagctatcagagaaaaatagaagggaggagaagcaaaaatatcaagaatgagagaattagaaagaaaaacatcaagaaagacagaagggacatttatggatagagataagaatagagaatataaaagaagaataaacaaaaggcctaaagaagaccatcaagagagtgtgtgtcttttccttaaccccctcagataaaaaagtcttagtattcatggattccctttgggccctgctgctggatgctggtcccccaggcagcagaactcagtgatttagagcactggctgctcttgcagaggctcattcccaaattgtttccagcacccacatgacagctcacaacagttccagggtattcaatgcttctcacttccaagggctcacacacatatatacacttgggcacattgctttttttttattttttaatgcttaaggaaagctcaacaccaacataacattctgagtgacactgaaaagcacttagctaccagctcccaaacccaaatctgtttcaggctgagtataagcacataaaccattaaaggcagatgaaaatgttgcagggctttgaagtttttctgcccttgacaagaagaattcaaactaatttaacatgacacaagaaagataaagcaagcaaggtttagtaactaacagtacatgtgcaaaggatctaacaacaaaatctgtggttcggttcagtttgttttttgagagagggtctcactatatagatcaggctggcctggaattcacagagatcctcttgcctccacttcccaagtaatgggatttaagatgtacactaccacaccaggctacacaggccttttaacccagcctgcccactcttttctacatgattctctgcatctcaatgggtaggtttaaaatatttcctaccctctgaggttggctcttgaactagaagttccttacttctttttgaaatagctcaagttcttgtggttgttctcatgactctctgttggttagacatctgttgcttcaaggtaaacttctgatactttaaaattgaagccagggttttgtgatagctatcagccagtaaaaatggaatagggcttagactgtgttgtaggctcttctctcagcttgttttcatatctcacttctatgtagtaagaaaggcaggagtgaccaggtatattggtacaggcctaaaatcctgacacttgggaagtacaagcaggaatatttggagttcaaggtcatcgtcagctccagagtaagttccaaggcagcctaggctacttcagaccctgttggggaaaaaacaaacaaacaaacaaacaaacaaacaaccacagtggactggcaagatggcccagaaagtaaaaaacacttagctccaagcctgacaatttgagttcaatctctgggaccatatgatagaagcagaaaaccagttcccacaggctgtcctctggcctccactcacatgattgcatgggtatatcctcttttctacccacccaataaataaatagataaacaggttattaattaattaaaaacaaaagaaaaacattgttgtttttttaaaaaaattctaaactgggtggtggtggtgcacacctttaaccccagcactcaggaggcagaggcaggtggatctccgtgagttcaagaccagagctagttccaagacaacctccaaagccaaagagaaaccctgtctcaaaaagaccacacacacacacacacacacacacacacacacacacacacaagctagagtcagtgagatggcttagtgcgaaaaggtcctgatagtcaaccctgaagagctgagttccatacttgagaaccacatagtaatagagaaccaatgcctgtacattgtcctctgacctctatgtgcacctttgtacacaccaaaataaaaccaatcaacaaaagcaaaatggtgacatatgttgcaggttaccttactcggacaccccttgggagagagggtgagaagacaaagcaccaacaactcaggcactgggtgtcagtgagtggcagagcaggttgcagactcatttatttagaaagttatgcctgcctttgtacccactactagggtcctatttattgggtaaggcagctgactgctgtgttatccttttctcattggtgtctctgggtcaggtgtctctctgccagcgtctctgggcattgaggcaggcttggcttggctcttagaggaagtgtcctctctacatgtgcatgtgcatgcagactggcctgggcaccccgggacaggcgactccggcttggctaagctggctgaagtttctcctacaaacatatcccagtgttcctcaacctgtgggtcatgacccctcagcaagcctctgtctccaaaagtatttacagtgtgattcataacagtagcaaaattatacttatgaaatagcaatgaaaataactttttgactggaggtcaccacaacaccaggaactatattaaaaggtctcagcattaggaaagttgagaaccactgctgtaaccccgtttctggggttgcagaagtaagccaatttctgtgagtttgaggtcagcctggtctcctctaggctacatagagactctgtctcaaacggcaaaccaaaaacacacaaaaaacacaaaactatgatataaaattctgttgattaggatcttagtctgggttactgttagcatccaggcattatgctggcctcccttgaggacctaggagaatatgtcaccaaccacaaccactccctatgcacatgcacttgctagcatcatgctagcctgcccccagttgtcttcagctgtagccaggaagagcatcccctgcacacatgtgttctcagcattcaggcagatacctgcccagcccaggatcctacagctgccatgtcactacgtagtctgcatgcatgtgctatgtcattgcgtagtctctgtgtgcatgtgctaagcccctttaaaagcaaactctgcccatttccccttccctttcctgctgctcttctgaagaggtaggcaggcctttgctcctctcccttcccaccccaataaacctccaatgtgagagttccttgtacagtgtgattcatcctcaccactgctactacagtaactatttttgtgatgaaacaccatgaccaaagcacactggggaggaaagggtttatttggcttacacttccacatcatagtccctcattgaagaaagtcagggcaggaactcaaacagcacaggaaccaggaggcaggagctgatacagagaccatggagggatgctgcttactggtttgcttcttttgacttatgtcaggagacagccctgattagatataaaagtctcctttacaagaggcctggcaacctccatgcttggattaccgccaacgtagtcaaacacccccaccccctccccgaaggttagtgttctgagataaaccacaagaatgttctgggacacctgcctaggcctgaggacattaaacacccattcctccccctcccttacttcctctttctttacttcctctttctttgtctttaagaactctttgcttaagttcaataaacagactttgacagcccaatgcttggtctcgctctttctttctcgcccatttattttcaggcttagtccccctcgagagccgcaaattaccagaaccccgctggatggggcaggtggcgcccaacgtgaggcccaaggtacggactcttctccaaacggagaccctccccaaggaaaccttcggcagtgcacgccaacaaggaagtcctgctcgccgattgcgatggacgttggtctgggaacgttatcaccactcatgagcaactgattccctggtaagtccccctcattctattccataataatgggccaaaagttgtctaaggaggtcaaattcattagggattttaagacttcctttnnnnnnnnnnnnnnnnnnnnnnnnnnnnnntttttttgtcaagaacatgtccatgggtcattttagaaagcccagacattcatcccctaacttggaaaaaggtcggagaggatcttaatagattactcaaagaaaagggacctgaggcagttcccttacagacttttagttattggaatcttattaatgatatccttaccaattcccctggctctgcccaccttacttctgcaattaaaaactttcttgagcccctctcctgtgctcattctcccacttctgactgccccatagacaaacctccatcctctccctgtccttcagtttccatctgtatgccccctgatgagacccagaccccccacatcttacagacaaacctcccttaaaagcccccgtaatctctatccctctttacagggcctcgagcctcattcccctaaaaaccttaaaagttaccctgtctttcgttcaaaccccaaaccataaactgatcacctaagtccatcagacgaggaggacctagaagaagcggcggctgcttttcacaaccccaactggcctcccttcgagggctttacggcccctacagggcttccgacttatccttccgccccccttctcccatcttccacaaacgccttaattcaagctaaaaaacatctcacccaacaaatatcagaacttaaagaggtcttacaattacaacaggagttttcacagctgtctctatacctcacatccctccagaccactgttggccaatcgatcttcggactccccactcagcccattacagcccctaaaccctcccttccaccaggcaacaggccaaaaatctccaaatccactaagctggcctttcctgacttaacccctcaaggctccaagcatacaccatcctcctctaaccaagacccctcctctactcatacaattaggcaggaggatgaggaggaaaactcagagatgaaattaataagagggataaaaatgactctgagtcagataatgaggtccaagataaacagacagaaacaaccgaaaacatctttaaaaaattaaaatttaaagcccttaaggaacttaaatcaacggtcgaaaattacggtcccattgcatctttcacccttggcttactggaggccctctcaggagagggatgcctcaccccagctgaatggcaccatgtcacacaggcagtccttagctgcgggaaatacttaacttggaaatctgaattctatgaccgttgacaaaaccttgctaccaagaatcaacaaaggccctccactcaaaaatggacccttgataaactcactggtcaaggaaaatttgtctctgaaattctccagattaagcttcgcataggtctcttaggacaaacctctcagacttctactggtgcttggcaagctctctcaggccgagggtccatgcttacaccccttactaagatcattcagggagccaatgaaccttatacagaatttgtagggagacttacagaggccacagaatgggttttgggcacacaagaaactgacaataaactccttaaacaactagcttttgagaacgccaagagtgtttgccgaaatgtcctcagaggcacctttagaaacaagtcccttgaggaaattattcgggcctgcaatgatgttgactctttttctcaaaaactctcacagagcatttcccagggggtcactatggctattggtgcagctctacaaacaacaggtaacaacagagcttgctttaaatgccaccaacctggacattttgctaaacaatgtccccaaaatattacacccagaccttcagagggcatcctgacatctcgatcccaaaatggcatattgacctttgccccttcacccttgcagaaaactctctgtcccaggtgcaaaaagggtaaacattggctcagggactgtagatccaaaactgatgttcaagggaatcccctgcctcctcctcagggaaacnnnnnnnnnncagccaatccccttcttgccagcatccgggccaagcctgcaggcacaatccttccaacctgcgcctccaagctctacagagccacccccggaagcacaggactggacctgtgtgccaacaccgactcaatattaaaccctaaggatggtgtacagattctctccactggaatttctgccccaccgcccccagatacttgttttctcattcttggtcgagcctcctctaccaccagggccaggggatcgttgagagatctcaccaaacactaaaaacatgctatttaaactatattcaggaggaggaattctataccccactaaaggcaatcacaagaacctactcaatcatgcattgtttgtgctaaatttcctcacatatgatgccacaggaaaatcagcctcggatcgcctctggcatccatcaacggctcaaaactatgctcaggccttatggaaggatcccctaactcataaatggaatagaccagacccagtcttcatttggggaaaaggacattcatgtatttttgatactcaggccaataatgccagatggttgcctgaatgccctttaaaactatataatccacccagggaagcccctgagaagtcttctaattctgcttaattccagataaagaatgatgtctttctggctacttgtgtgtttctcactctcaattatcgttgccgctgcaatctcctatcagatctacaactacaccaggatgatcatcaaccaagctggtgatgttgccaatgcctctacatacattggacctcagccctcttattcccccctgatagtagctctttgtgccttggctatgggagcccaccctctctgaggaacttgcttttatgcaaaaccgggcctcgttgaagaaagcctaaaaaaggttcaggatagcctagagaaccgtaaaaaaacaaagagaacaagcagaatcatggtacaaaaattggttttccacctctccatggctctccactctgttaccttccatacttggtcctatggttgggtttctcttattaatttcctttgggccttggccttttcaaagattaaccagattcattaagtctcagattgacaacctcctcggaaaaccggtttcggttcattatcatcaactggaggtaggagaccctgagctgcctgaccataatgaaaaccccaacaatcctcctaaaggcctagatttttcaggccttgaacatcgaacctctggatttccttggccttggagacgtcaatgacgtcaatgacgggattatcgtgatgccgcaggccagacgccgacccatctcaccagctgtagtgctcctcaatgacaggattagcatgcggctgtgaccccaggggcccactccaagcactctcgagctgctggccttatgaaacgtcccctgagtgctgggggcagattcacctcacgtagcctaagacagaggctctacccctcactgtcatataaatgacaatatcataaacatagggtcctggctgctgatgcccatcatgtagcctaagacagatgctacattctattatacatagaagggggagatgtcaggagccagccctggtcggatataaaagtcccctttacaagaggctggcgaccatgctctgggacacctgcccaggcctgaggacgttaaacacccattcctccccatcccttacttcctctttccttacttcctctttctttttcttttagaactctttccttaagttcaataaacagaccttgacaacccattgcttggtcttgctctttctttctctcccatttattttcaggcttaatccccctcagttcccgcaaattaccagaacccccctggacagggcagacttattcagcctgctttgtcatagaacccagaccaccaagcccagggttggcaccacccacaatgggctaggccctcccaataaatcactaagaaaatgctctacaagcctgcctacagccaaatctttttttccccctgagagacagggtttctctgtattgctttggtgcctatcctggcactcgctctgtagaccaggctggcctcgaactcacagagatccaccggtttctgcctcccgaatgccggcattaaaagtgtgcaccaatgcccggcttatagccagattttatggaggcatgttatcaattgagagtccttgtgttaaactgacataaaaatagccagcacagttttttaaattggtttttatttaaattaaaaacagtcttgttttacataccaatcccatttccctctcccttccctcctcccattcctcccaccaaccctccccccatcctaccccctatccactctctagagcggatgaggcctcccttggcggatcatcaaagtctgccaaatctaagctctcccccaagtatctaggctgagagagtatccctccttagggaatgggctcccaaagcccattcgtgcactacagataaatactggttccactgccagaagacccatagactgtccaggacccccaactcacacccatgaacaggggtgcctgctttggtcctatgctggttccccagctgtcagactggggtcactgtgctctcactaggtcaggtcagctgtttctgtgggtttccccagcatggtcttgacacctttgctcatcactcctccctctttgcaactggattccaggagttcagctcagtgcttagctgtgaatctctgcttctgcttccataagctcctgggtgaagtctctatgatgacatttaaggtagtcatcaatctcattatataggaggggcatttaaggtaccttctccactatggcttagattcttttgtttttgtttgtttgttttttgtttttcgagacagggctttggaggctgccctttgtagaccaggctagtcttgaactcacagagttccacccgcctctgcctctcgagtgctgggatcaaaggcgtgccccaccaacacccagctattgcttagattcttagttggggtcatccttgtgaatccctggagatttccctagtgtcagattttctagttaaacccataatggttccctctattaaggtttctcttttcttgctctccttttctattcttcccccaacgtgaccttcctgatccttcatgttctcctccctgtccccttctactctcctctttctcctacctctctctccccagtcccccgctgcttccaatttgctcaggagaccttgtccctttccccttctccaaggggttcatgtatgtctctcttagggtcctccttgtttccagacttctctgggtttgtggattgtaggctggttatcctttgttctatgtcagtgccattcttgggctagtggtcctggagtgagagcaaattaagcagaaactaatacttaaaaatctatctcaatcatgggccagctaacctattattgataagtaaatttctcttttcaaagctgagtacctctctgcccatgaaatagcttgtgaagaactgttagaggagaaaaagctcctggtcacaaaaatagaatctctgacctgggtggagacctaaaagtccacttaggctggttcaatttctttggctaagtacctacccctaggaaggcagactcaccttaaccatgctaaagagataggagtagtatgtagttatttaaaaagaagccatatttctccttcctcgaatccccacttctcgtgtagaagctcatgtaggatcttaagtctggcagcttttctgaaattatgcacaaacgtgtaagttttcctttactttgttacatttgttttctaagcatgcttttattaacactttgggtccccccccaatattttggccttccttaccgaaaggttcagactttgacgctgattggctctacctttttaagagacagaccctcccccctgacaacagccgaggcacgcacaagaaaacgtgctacgtcatcacatgtcacccggcacacatgaggactctgggcatgcgtggaaccccagtgcacatgcgcagtcttccctttaaaagctccaactttcctgcttcactctctctctggttcctctatttatgctgctctctctctgctcactccttctctgctcttctcccacctacgagctctctctgcctctctatggcgaccggccatggcagtcagccattacccctgttcctcttctctcttagtctccctactctgccgggccatataataaactagttaacatgtctaatcttgcatctttctcttttcctttctttaaataaagacataacacttactctttctctaaaacccccctccctgtcatgtggctgcttatttatcacgcctgtcttccacaccagtttacacagcatggattttctcttctctccttcatcctcctctaggcagcttcccaaatactgggattaaaggtgtgcaccaccatcacccgtcgagtaattttatatgggattctacatcaaggagataaaaattctagtcaaacctgaagtggcctcatcaagaatacaagatagaggaatgtctgccctcttaccctgtcacagtaccaaaatgaaaaaagaccaaggaccaagtcttgaaaaattcctgtgttaaatggcaaaggagaaagcttgaagacactagaacaaccagggagcaaggagaatgacaccataaaggcaaagagaaaattgttcacacgagcaaaggtttttcacttctgccaaaggcatgtaagtaaactggaaaacattctttgtatttgagaatgaggggttaattggagacctgagcctagaaatacgaaagaccatgaataattaatataattctgaaaacaaagttgaaggagtttcacatcatgatttcaacacttactacatccagaagtgtggtactaggtgttaagtgccagctgatcccatgtcctggggtgccataaagccctcagttctgtttttaagaaaagcataattctgccaaatggacaagataaccccaggcaacaactactcaaaaaaaaaaaaaaaaaaaaaaaaaaaaaaaaaaaaaaaaaaannnnnnnnnnnntatatttgctgtataaatctccaatctgaccaagtgaccagactagcagtttcctgtctctgtttaaatgtcggagcctgctccaacaagacagctgggttacctgagtaggggcatgaggattgagaaatggcagataaagaaagagtcagaaacacaggatagattcgggaggactgcctggtccatgcctttcagcacactggacagccctgagtttatttttgaacctgcttatatatagactaaaggcaaagcagaacaaagagcagaagcataatcagttaaccagctccctgcactgccattgaatcgaggagcagcctggctcactatctatcatcattcgggtcctagtaagcagctgtgttatctagctgtgtgcctacagcttgttagttagataatatgctctttttcatgggcttagtcagaactttctctcggctctcagggagactggagcaagcaagcttgaactctaatgttataagttagaatagactccagatagaaactgagtcacttgtgggctcccacacttaaaatgttcaagatgtaacctggggctggaaactagaagagatttgaggatggcagcatatgtaaaatacataagcctatggtgtatataggttagtaaagtcttcttttagagatcaactcttctttgagcattagcctatgtggtaatatattatttatgatttattaaagtcagccacaagctatagaagccaggcaatagtagtatatgcctttaatctcaccactagggaggtagaggtagacaatctctgttagctcaaggccacactaagctacaagaaatatatccagtcctaaagagaaacagctcacacaaagatgatctcagcacttgggaccacacgcctttaatcctaggaccaatgagatgtaaagggccataggcccaattatgtgacttaaagcccaaccctgtgagcctcctgtaacctgtaattagatacggtttggctaagcgggactactaacgactgctgttccgagaaaaggccgtggggccttcctgcttgctgtttcgaagataccacaagatgttccagctgataccacaagaatgttctagcccaagcaaataccagacattccttcctgctattctccccgcttgcctcacttcctcattgcagggctatttaagcccgtccccttgcttcagtaaatgagaccttgacattgtacagacggactcttgtcttttcttgcgctgcttggtctcctttctttctctcgcccatgactctttcaggcagccccttcggaccctgaagaactgaaccctcaggacaggtcgatgagagatatttaagacagaaacagggaggatctcagagatggcattcattctccagccacattgaggagaggaagacattcagtctcaggaatctctagccacactggggagaacatagcagtctgagtgaatctgaggagcagtgaagtcgggagcaatttgaggattgtccctttggtctgagctgaggtagaggtagtagctggctgctttgcttttctgatctctttttttttttttttttttgctttttgagacagggtttttctctgtagctttggagcctgtcctagaactcactctgtgagttcgaggctggcctcgaaatcacagagatctgtctgtctctgccttccaagtcctgggattaaaggcgtgtgccaccaatgcccagctgcttttctgatcttctccttgaagctggaacccctatatctgtctctgggtcttttatttttcatgctacaagcctaggctagacaagcactgttaaagagtttttgtttttgctttttgttttttttttttgttaatctctaagtgtgtgaagtgatttttcattgggaaggcatattatttctgtaacactaagagattatctcgtgatagacagacagacacacagactggcagacataccacacacacacacacacacacacaaactataggacctatgtaaaaataaccttcaaatttcttcaaattgtttccatacttatttagtagtatgctaataaaatataaagagaggaattttaacaccattaaattatacatggtacacactactatgatttttgctttattcagcaagtcatagaaatcccttcaagacattatagtaactctcaaaatattgaaaaaataataaataatacatgttaaaacacagttgagactttgattaggatcatggtagtatatgttgaaactactgcagtaaggtcttacagtggagccattgggattaaatgcaaaaacatcacgtacaagtagaaatttagaagtaagaagttgggtcagggacagaagaaaaagtgccaaacaggaaattgtcagggatgaaggaaattctggctaaaccaactcaacaggccaagataaccatgtatcacctgcagctaaaattctaaccctatgaagagggttagacctcatgaccatggcaactcttatgaagtaaaacatttaattgggccagcttacagtttcagaggttcagtcctttgtcattatggcaagaggcattgtggcttacaggtagacatagtgctggagaaggagcttgggacttcaacattcagctccataggcagcagagagagagacactgggcctggcttaaacatttgaaactccagagcccatgcttccttcaaggccacaactactccaactgaaagacccccagaagctcaggcccccaggttctcagtccaggaactcaaccatcccaatcaccaggcagagtcggaagcttgatgcaaactgcacgaggctttattatagttgtttaacaggctaaccccatgttagctcgggtctttcatccacccaccatggcagatggctggggaaagacagcttgaagcatctgcatagagatattatagggcagcataaggggagtgtctaggggtaagcacaggctcagcattggtgtggctccaggcttggagggtttgccctgtgttgattggtcaactggttgttatggcccataagccctcccagggtggttgctatgctctgtacgtcattgctgtgcacttgtctgtaaagcacacccagagccgtaaagcaagcaccaccagctaacttctgattggttccttgccacgagacaggcgcctaacctcctagtgaccaaggcaaggtcagataagcacgttttcggctgttatggctgccgaaagggacaggcatctgaccttagtgaccaagacaaggtgaataaacaggaagccaaaaaggtagtgaatcctttgagaaaaggccgaagaacttcagctctgggaaggacattcagcccaaaagagatctcacacatttcatcaaatggcctgctacatttggatgcagtgtcaaaggtctatcctctctataagcagctcaaagtacctcctgtgttgtaacctgtcttttgcgggcttcagtcagatccagcagacttgcctggatctcttgtacttgagagggagagtgtggattgagaaattgaaaggaccagctccccatttcggcagccataacagcctaacacttgcttgcctgaccttgccttggtcactaggaggtcagatgcctgcctatttcagcagccataacagtctaacatgtgtttgcctgaccttgccttggtcactaggaggtcacatgcccgtctcgtggcaaggaaccaatcagaagttagctagtggttgacccgtccagcaggccaggttattcgcgggtctcgagggggttgtcacctaaaggggtcatgagggcgagagaggagagagaccttgcggcgcaagaaaggacaagagtccgtctgtgcaatgtcaaggtctcgtttattgaaaggtaaagcttgcttatatgcaggggatttttactcagggcggggtaagggagcaggaggaatggaaaattttcaagaggaaatagaggcaaggtaaatcttagcccatggtcccannnnnnnnnnnnnnnnnnnnnnnnnnnnnnnnnnnnnnnnnnnnnnnnnnnnnnnnnnnnnnnnnnnnnnnnnnaaaaaacatcttgtagtcgcagcgattctggtcatctaacaatgattaactcttgactcagtatgaggccccttttggccctcgacaagtggtgctatgctttacggctctgggtgtgcttcatagacaagtgcacagcaaaaaaagatgcgcagagcatagcaagcaccctgggagggcctatgggccataacaaccagttgaccaatcaacacagggcaagtcctctaagcctggaggcacaccaatcctgagcctgtgcttacccctatacactccccttatgctgccctataatatctctatcctgtggtttctaggcatctttccccagccatctgccatggtgtgtggatgaaaaacccgagctaacatggggttagctcgttaaacaactgcaataaagcctcgtgctgtttgcaccaatcttgctcctctgcctggtgataggggtctctgaggtcctgggctgaaatcctgggggcctgagcctccgaggggtctttcaaaacatcaggtaaagacgctaagaaaaagagacacaggatagagtcaggagggcattccagtgaatattgaattgaatacaccaagtttatacttcatcattcttaagcaccccaaacaaagaggggaacatggtatcgtgtacacaggaataaacaaactttcttccttaattctctaagcatttggtaaccacaccttagactctatttcttgttatctggccttgagggtcaagagaaaccacacctcagaccaagtctgttgttatttagataagacatccaaggcggagagcaaacatcctatagtagccacgccttatacctttaggtcttatgacttactaaggacagttttgaactctctgactttgagccaagatgaagtggagccgtctttatgggtcctgaaaactcctgccaaaaaccagttcatccaggccctggactggaaaactgcaacccagttgcttatgcttgcccacaagtataggccagagacaaagtaggatgatggtggtaagtccttctgtgtatatgtttctcttattggttaacgaataaagcaccatttggctgattggccagacaggaagtgacatagctgggcaagaaaataaaacaaatagatcaactctatataacctagttaagcactttctaaatccccctacacaaaaaaagaagttttcaggatcagaccaagaattcatagtataacctctctgattttcatccatcaggttgtctccttctctgacacagagatagtgagtcttacatgacaagtgacttttctattactctttccagacagtcttgaggaattgaatgcttccacttgctagaagcatgaacaaaaaggatgaagtctcaaagggtcaattccaatttcatcaaaccaaagtatattctcttggagatgacattatcaggcaatggaacctcctcatgacttcaccttgtcaactactaaaacaaaattaagggattccttgaactcataagcatcacagccacaggaagctgacattttctttactgggttctccttcatatgaatttaattagtttacaaatatggacccttgtcctgaacagactcactactcttaggactccaaattatgacaaagttttatatttgtaattttaaaactcaggacaaacaatagagattttaacacagtggacaccagagagccatggtttattgtatcttcttgacaatggactccaaatgtataagaacaagtccggaaaagttcttcagctcagtgaaaatatgtggtatgagacagtggtaacctaggtcattctgaccagaatgctgtttctgccaatccttggcatccataacaataataaataatctttataaaagccctttcccacccatgtcagtttgttcctagaacatgtaatacaagtgagccatgacaaatcagcaatctccccctcacacgaatatttttgtttatgggtgggtgtggtgcatggcacaggacacctgtagagatcagagagcaacttgcagaaatcagttctctctttccactgtgtggattctaggaattgaattcaaatggttagatttgacagcaagcacaagctctttatgaaaacagcctcacaggcaccattttggagcacttattctaaacaactagaagatggtgcccaagtggccatccttatcactgtgactacaataaaccttttgtttgcagctggtgtgcttcaacttgccttttaagttgacattatcatttgaacccttacaaaatgcctcacccttttgtttgggtgcaatggcaacagccacaagaagccaaggtctctgccctatcaccattcaacctcatgttgataatgccactaaaatgaaaataccactagactgactttcaaaaaaacaggagggggggggatcccctccttttcacaaattgtatgcattgcagaaatatgctagaccccaccactcacactccttgacacaaaaggtccagttgagatctaggacctctttcctattgagaggtcccctaactcctgcctagaacaaaaagacagttctgaggtagtgctggcaaactgtcctgtgctatttaagctcactgagaagctgggtgtggagatgggatctggccaatttacttcagactcaagcatgtttgtctcaaaatgtcctccaaatccctgtcttgggtcaagctggcctcttgactctgtaacaggaaaaagaaaaacaaaacagctcagtaggtaaagacatggtaccataaggacagctatgggcaaactattttcaccagaggttactactatttatagagagatgtctatagtaaaaacaactactgtaaaaggatacaaaaagtaaagctagtccctgactctgtgacagggagaaagcacacagtgactgttataatgctgccggaactggactggtaacattccttggggagatttggggagttattcactacctggagacaaacagggttttgagttcagtttgtttgtttgttttttggttttttttgtttgtttgtttggttggttggttggttcttggtttttcgagacatggtttctctgtggttttggaggctgtcctggaactatctctagtagaccaggctggtctcgaaatcatagagattcatttgcctgcatgcatgctgctgctgctgctgccaccaccacctggattgttttactttttaaaaaagcacctttatctcttcctctttcccttgtgtcttctgcaagtgaaagaactcaacctgtgaaactagttagctatctactgacactgcttccttgagctgagatcacaaaattccttcctctgtttattttgctgttttaggcctacctgtgtacagcataggtaaactctcctcctatgtccataccaacctaactaacgtgtctttttaaagggtataactacatttactggtaaaagactaaaaattaatagaagaagcaaaatgaggccggaatgtagttcagcaactccactcttagagggccaaaaatagtcaaattccaaatgtttcagatgaccacagacctcccaggcagttcatggagaaaccccaacaaagggtcagcaactgccatttacttaggcaagattgattagcacatcccgaggtctgagggttttacaaccggtgtgtcaggaggccatctgattcccagccctcccctcaagacaaaaggcctcctaggaacccatgactctcgtactcaacagtcagagggttgcagcccctccctaagcttgtgggttttgcctttaaaaacacctgtgcctggagatcagggcttctctctagcctgcctgctgaggaggcccgtttgtacaaacgttcacctttcttaaagcctcttgcatgttgtatcaactggactggatattgagttcttgggcgactgtccaggttggagattcctcaatctgaggatcttttgaaggactttagaattaacaaagaaataactaagaagaaaaacaatcctctcaccctaagaacagggagacctgacttaaaacctaaccaaggtcacaatgacccaagcccctggaatttcttagctggcagaaataactcccttacaaggccacaagacaacctaactgaataccaagaattcctagagggccaccctgccctagggtcatgaagataaaaacagactatcccactgagccaggagaccatctggacccaaagataagagatctccaaaggatctgtgactctggtcacgtacccaaacccctaaaagcctatggttttttctcctataaaaggagcctgctttagaggaacagggcttttctttgtctgtcggactgggaagcccgtttgcgcaaacgtcccataataaacttacctcttgtttttgcatcagctggactggacattgagtgtttttggggggatcgtccgatttgtagagactcctcggtccgagggtctttcactttcactgggtgagatggttgatgccacacaggcttgttgcctgaaaggaatgggttcactttgtcacggagctgaactcaccttgagcagaaagcagtcaggtgttttgcagccgctttgccctctttaaggtggaagcaaccatgtgacttgaacattatctttgccaattaaatcatgaaagaggaaatgtcatgtgactttacctccatcttggttaatgtaaccacaaggcataagtcaaaacagagacatccatttagcttcccagtcccactgaaccctcaagaggatgacaaaccctttttatattagactaaggaaaagacatccaacatcaaaagtgttcattttgtaattttaatgtttggttttgactggactgttattatatgatacagttattatatgatacagttactgacttctgttttttgaaacagggtttctctgtgtagcagctccagctgtcctgaaattagctctgtagaccagtctgtcctcaaactcacagagatacacctgcctctgccttctgaatgctgtgatcaaaggcatgcaccaccactgcctagccatttactgacttctaagaggacctgggactcaaggagtaaattgctaagtgctagacaagctgctgccagcaaggagctgttccacagggtctgtctgaatgcctactatttctgcatggtatcttcaggcctgttttctctaactggtaaaatgccccccaacccttatgtattccttacccttactagttttgttgttctgaggttgagagacccccaatcaagacaaccacatagccagtaaccaatgcccacacacagggtttattgattacaaccttgagcttggagcctcaaccagcattccaacacagcaggtgaaggagatcggcccaaatgctcagggtaaggagtttttaaaggaaaaaaagacacaagtaggcagcacatgtgttgagggccaaaaagaatctcaagcaagatcttgcacagccacctgctctgacctgttctaaccacaagatgttctttttagataagttgctcaaaacatgttttacaggatgttcctttacttctcggaatcggctgcggttggttggttgcagggacatgggccaaggccaaccttatcttcacttcctctaaaaattttccattcctcctaccctcctaccccaacccgagcaaaatcccctacatataagcaagctttacccttcaataaacgagaccttgatgcgactcagactaactctatctttctttatgcgcttggtctcatacccttctcgcccccattgacccctaggcgatacctcctcgtgacccaccaattacctggcctgctggacgggtcacagatgctttggcgtttcaggattgggtaaacgtttgtgacctttaaattcattggttagggtctagggtctaaaactgttactaacagttgcccacaaggaagcctggggagagtggatgtagtttatcaaagttagtcattggctgactacctgggcagggtctctttggggcaggctacatgtgtggtttttcttaggactgtttatagctactttcgctggagctgaggcagcccccggccaagtgtaaaaatggaggttttttctcaaaatggagtttgttctgttccttcaatttgactttgtttctgcctgaccttcaatatgttttttgtttgtttgtttggtgtttcgagacagggtttctctgtggctttggaggctgtcctggaagtagttcttgtagaccaggctggtctcgaactcacagagatccacctgcctctgcctctgcctctgcctcccaagtgtagggattaaaggcgtgtgccaccaacacccggcttgacctttagtaaacttcaatctgtttactaaatatctttgtcaagtttctcttttgtcaggtccaaagggtaccacgaccaataaaaggcaggcccactaactgctccgaaattgagtctagacccagctcaacctggactataggaggatttctggtgcttagaagccagcattcctcagtaacttgtgaatcccattgccatctatcaaacagaatcacttcccttacctctgtgaaaagagatgtatggctctccaactaacatgtacctgtggcacctatcatcaaatcaagggccatgctagcctgtaggccagtagttatctaccttcctaatgctgcaaccctttaatacagttcctcatgttgtggggaccccaaccataaaattatttttgtttctacttcataaatgtaattttgctattgttaagaacctgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgcgcgcgcgcgcgcgtatgtgtgttttccgatgatcttaggctaactctgtgaaagggttgtttggcctacaaggggtctttactgtgtctatcaaatataactttcacaacaagaatgataaaaatcataatcagaataagcaaagcattcaaaatcttgttatattaaaatgtatcttttatatgattagttatatatagagtatgtatgattttgtacttagtaccaagttgacttataagtactcatataaactacagtttataacttgacccaacttagttttgttcacatttaaactaaaattttaaaaaataaaacagtgatagacaaatatgcatttaattaatgtgacaatatagataaaataagaagagatggtggttaatgatcctaaatctttcattggacaatgaacataattgtttacattgtaatttgatttttgttaagggccatgggccctaaactatgggtttaaagcccatctttgtaagttcttttatgacctttaagttttcggcttaaaaccagctctgtgagcctcatataacctgtaattagatggtttggtcaaacggaactgctaactgcttctgttccgagaaagggcctggggctttcgctgttccggggaagaccacaagatgttctggctgataagaacactccagccccagcatacaccagatgttccttcctgttattcccccgcttacccaatttccttggtgcagggctatataagcccaatctgagccccaataaatagagaccttgacaattgcacagatggactctggtcccctcttttgcgcgcttggtctccttcccttctctcgcccatgactctttcaggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcatctctttgaaacttatcccaattctggttctacaacatggtccttttgcttgagggtataaattaactttaagagattatcactcctacttcgggacacctttgtcctatggtataatagacctccctttagtaatactttttttttttttttggtttttcgagacagggtttctctgtgtagctttggagcctatcctggcactcgatctggagaccagactggcctcgaactcacagagatctgcctgcctctgcctcccgagtgctgggattaaagtcgtgcaccaccaacgcccggctagataataatacttatatgtgtgcttttaaatgttttatgaataagtgaatgtatatataaatataaacatcttaaagatttttttcattttgaagattacaacttcttttaaaatgatatgttaaaaaattatatatatatttcttttgcgcgcttggtctccttcccatctctcacccatgactctttcaggcagccccccttcggaaccctgaatgactgacccaaggtacgggtcaagtggcgcctgaacagggacccgaagtacggtcagctgtcggacggcggaaagacagcccgggacaaagaggaccctgcagacggacagactccagccctctccaggtggaggtaaggtaccaatcattgccgtccaaatgtcatgggtactttcattagtaaggagttgcaatttataaggaaactcaagacaattcagggagaaaggagtaagagttaaaaagaaagataaaaaggagtaagagttaaaaaggagaagataaaaagaaataagagtcaaagtaagagtcaaaaagaaagatttagttcattttttctattttattgataaagcttgtctatggttgattttaacggggccagacatagctccccagacctgggaaaaggttgggagagttacttcgcccacagcagagaactcacaagccgcccacagcgagaaatgctgctggcagcatttcttagaggcagtcaagcttgggggctgcaacttacagccttgggagatgcctaatcaatgtatagaaatgctattgatacagccagacagaaactgtttttgagacttacaaagaagaaagggcaacatatttaagcttagatttgttcaaattttggatgctcatatacaacgattgactataagctactgtgttagaaatttcaattagggatttttcttttctacaagctgatcataacctaggcaaaaggagaaatgtgagacgtatgcaagttatgaatgaacggtgtggccacacctggattcgtgatgtgattgtgaatttacaaatgcaaatgaatgaaaatgtctaaattgccttggatatgattagagatatttatattgcctcggatatagttttaaaaatatcaaaatcactttaatatggtcaaaaagagcatccagtcagtcagtcaatgtcttaacaggagaaattatgatttgagccctaggagacagtcaattaaaaagttagcaatagcctatagcatttagcttagagacatgagaaatctatggatgattctataaaatttggcagatgagaggataaaggtcttaccaaatttttatggttaaaaaaaggaaatctagaaaattaaagttgaaacatgattttaaaaagggtttgtaagaagcctcaggaaagagccaacttgttagattcacagcttggcaggtcagctaacatgcaaatgaggtcttatcagcttgtcagcctcgaaggttagattagaaaaggctactcaaaaactctaaataaatctagagaattgttaaagacatatgttatattctaaagaaattaaggcttgatagataacaattggaaaagataatttaaaaatctttaaatgagtttttagaaattgttataaaatattcattggttaagtacctttttgggacatctaatgatagcctacatggtacagaaatgtcatatagattttagaaagtattttaggagaaaaccaagtatgatacatgnnnnnnnnnnnnnnnnnnnnnnnnnnnnnnnnnnnnnnnnnnnnnnnnnnnnnnnnnnnnnnnnnnnnnnnnnnnnnnntgtctttgctcaattttcaggaagaattgataatcaatttctagttcatggactgttacaatttgcactatacatccttttgtatttctaaattataaaaaagcagtcctataaaaatatactatgttaatttttaccaatggttctattgagagagtcacttgcataggtcattaataaaaagaaatagagcagacagctctgacttcagctcaaataatcaaactacaagctgttgcaatggtcttttaaatcctggtaaataattcatttaatttgtatactgacagtcactatgtttttaaggcttataaggtaacagaaacagtcccatgcacaggatctggtaatagccaagtcaaaatgttatttaagcaaattcaaaatgttactcacttaagagaattatcgtgtttatgggtcacacggggaacctattaaatagtcctttccctgattactggccaaatggaatgaattatctgattaacaaaatcagttggtttgccttaaatagaaaaggctcgacaggcttgtaacttttcttcatcataatagcaagtctaagtaagaaatttggcttaaccagagagactgctggtcaaatcatcaatcaatgtagaataggtccgcaatatggctatggctaatttaaggattaatcctcaaggcctgctccccaaccatttatggcgaatggatgtgactcacattacagagtttggcaagttaaaaatgtgccactccacaaacaggagaagccaccaggcatgttataagtcactatttaagatgttttgcttacatgggagtgccagaagttataaaaacagataatgggtctggatatactagcaaagctttccagcaattttgtgcttaattcccggagaccggtgctaccggaacagcccgtatggcctagtcccgaccagtgcgcgtggacctgcctgccgggcccgtagtggcgagagggctgggcctttgggcctttggggacgcagcatgctgctgacttgggggagtgaatcacctgcctccgagcttttatagcggcagtgagacatgaggcgagcccacagctcgggcggcggtggctcctgagccggcgggatgtacaggccaggcagtggtggcgcacgcctttaatcccagcactcaggaggctgagacaggagatcacttgagtccaggaattttgggttgtagtgcgctatgctgatcggatgtccgcactaagttcggcatcaatatggtgacctccagagagccggcggccaccaggttgcctaaggaggaggagttctatgccatacattgtttgtgttaaatttcctcatgtatgatgctacagaaaaatcagccgcgcatcgcctctggcatccatcaacggctcaaaattatgctcaagccttatggaaagatcccctaacttatatatggcacggacccgatccggtcctcatttggggaaaaggacatgcatggattttaatacagtccaataatgctagatggttgcctaaatgcctttttaatccacccaggggaagcccctgagaagctttctaattctgcttaattctagataaaagatgctgtctttctggctacttgggcgtttatcaccttcgattgctgttgccgctggaagcccttatcagatctacaactacacctggatgatcctcaaccgagccagtgatgctgccaatgcttcacaactattaccttattctctccttaattaaccctactgttcaggcccctcatcaagccagccactcccttatggaggactgttgggtctgctagtcttccacccctcccctttttcagggaattgcaggcatttgatccctaccttgcctgttctaccggattgactatttactacaaacaggactccaaaatctaaaggactctttggtttctctatctgaaatgatgttgcaaaataggaggtcttgacctggtctttcttagacggcctctatgcagctcttaaagaggaatgctgtttttataaagataaaactgagttagcaagataatattaaaaaaagtaaagaaaaatctagaggataaaaagaaacaaagagagcaacaagagtcctggtataaaaattggtttcaacctccccctggttttctactttgctcccatctctcctgggacctcttataggactattgctgctgatttcttttggccttccaaagaatgctcgctttataaaaagtcagatagattcacttctccctaaagattttgtctctgtacagtgacgagcagagcaaacaaggcaaccccttgggccatcaagagaggcttaatttttctaaactgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagggagcagacaaaaaacttcaatgacaaggatcttttttttctgaggtgggggttttaagacagggtttctctgtggctttggaggctatactggaactagctcttgtagaccaggctggtcttgaactcacagagatcctcctgcctctgtctcccgagtgctgagactaaaggtgtgtgccaccaccacccagtgacaagactcttcttaatgggctttttatttcacagatttatggaataaattttgaagcatcaagggagctgagaaactttagacaggttaggatctgggaagctcctgggaagcaggacaacaacctccactggtatttacaactttgatactgtaagagaacaaatctacagatggaatcttccacccgaaaatcacctcttctgccttagaaaatccccaaaccccttgcaccttgaaacacagtctctacccactccccaccccatagatggctgcccttcctttttctaattagaggacagtctacctctgtagaggtgagtctctcttcctgcctccctccctccctccttcgctccctctctcatttttgtttttgttattcaagacagggtttctctatatattccccgatgtcctggaactaacgctgtagaccaggctggccatgaactcggcctgctgagtgttggtattaaaggcatgtgctgactaagccttgcgcctctttcttcttttttatgttaccttcatcaatcctgatctgttagtaagctatttctgttcagggctgttttttctttgtaccttagccagagccaaatgaatggtagcttttaaaaattttgacccctttattctctgagtgattagagtaaattctcactgcttggcttaatttggtagaaacaattttgccatttcattgtagaattagtctttttttttttttttggtttttcgaaacagggtttctctgtgtagctttggagcctatcctggcactcgctctggagaccaggctggcctcgaactcacagagatctgcctgcctctgcctcccgagtgctgggattaaaggagtgagccaccaagtaactacagttcttacttgataactttttgttatatattttactatgttaatgttaaacccttctttttatttacacaggaaagaggagatggtgggggaagtccttctgtgtatatgtttgtcttattggttgatgaatacagcactgttggccaatagggaagcaagataggtgggactaggagttgaggaggattctgggaaatgtagtagaggagtcactatgtgatccaggaagagaggatgcatgaggctggcgtcctcagtaagataagaccttgagaggaatatatatatatattaatatatatatatattaattatgagttaaatatggcagagttagctaatagaagctgtcattgaccaacagtattgtaactaatatacgtctctgtgtgttatttgggggccctaaagaggtggcagaacccaggcggctggtggaaacagttatcgttacaattaatgattaagatacccccccccccaccccaccacagacccagggcaaccaataacacagtgccatcaggttagggctgaatgtcacattccacactatcaaagactaaactaaacaccaagccagccacaaaccctttgatttacaatggggtcctgcctgaaagatcacatagggcttgtggcacaaaacttgtgggagtaatcaaccaatatctgatttgacttaagatccactccatgagatggagcccatacccaacactgcttgggtgaccaagaaccacagactataatagcatggggacctagggtgaacccaagtaccactgttctaaaaaaaaaaaaaaaaaagtagtgatacaataacttctgatgatacgatatattctgctgtactcacagacagggccttgctaatccatcatcagagaagcttcctcctgcagcagatgggaacaaatacagaaatctacatccaggcattatgcaaagagtaagagaacttggaacattctgccctaaatgggaattctctatcaaatctcttccctcagggttcagagaaccctacagaagaggaagcagaaagagtgtaggaaccagaaggggtggaggccaccaagaaaatcctttaagtcaataccatcaaagctcatatgaactcacagagactgaagcagcaggcacagtgccagcaggagtctgctctaggtcctctgcatatatatattgcagctctagtttaatgtttttatgggatcaagagtattcaaaccagtaggtctctgattcttgtgcctcctcttggactcttttccttctttttgtttgtcttctccaactccaatgtgacagcttttattttatcttactatattttattattattgtgataaagaaattaaaaagactccaactgagcaagaaacctgtgatcctatgctacgaaacaggaggccacaagcagttccaaaaaataaaagggacatcagcacatcaccgactgtaaacgctggcccctagcccttgtctctaagtaaattagatggcctctttatctgcctgtcataaatcccccagactacagggcatgttaatcagcccccacctaaatcaaacgacagttatagcttctttgctcaatacctattatctttccataaccttgtacaaaagctttgtaactttgtatgaaactttgtaacatgagatcatggatctcatgaccctcttccccttttttgacttccctgtttgctctttaaaataccttgcatttgtggttcggggcttcatttctcccgacagagtgaagccccttcctggttagctggttttccttgaaataaacaaaccttgtacttgcattgcgatgtggttaaattccttgaagccttggggttcctctcttgttgggcacaacaattatcgattagaagtctgttctcttttaatgagagaaagggattggaactgtatgggaggggaggtgggaaggaattgagaggagaagagggaggggaacctataattatataattatatgagtaactaatctattttcaatacaaggaaaattttaaaaacaaaaacaaaggactgattctagacgatggggatcctgttgcaggggaaacaggaatgaggctatgtctcacattcggaacaaaacaaataatgctcatttatagaatctcaacctgaaccagtcaactcaaggggaagaaagctagtactcccagagctgatcagatagctagctggcttgaaagggggttttaggaagggcatgaggcacatatctttagtaccagcagaggcaggctgatctctgtgagtttgaagccagtctggttgacatatgtgagaccaaaatagtaacaatataccttgcaggtaaagggcactgtttgcagttaagacagttaaaaataagttcctgtttgtcctgtgttaagtccttgcaagttaagatttctatttgtgattaagaagaagttcctgtttcttagatttgatgtaaattgcaaaacatatttgtcaacctacactaaacttataacctcattcacatgatgtatgaccctaccattggtccttccctttcattgtatttttctaacaatgtgtaacagccaactctctcactcttgtaaacactttatctctcacataaaagggacctcaggaggctagcaggggctgctctttaaaatcctgacttagggagaggcagtcagaatgaccagtcctgggtgcacccaaaatacagcttgctttaattggataattgtgtatttggtctttctctcaattttcaggttaacaatagcaatttccaggtaagtcaaggttgcctattgaggccttgtctaaaagaaaggtgaggagagggggacttgaattgattcggatacaaagtggggaaatgtttggtaaatgttccttaaccacataattttattatttgtttatttgtttttctagacaaggtttctctatgtagctttggagcctgtcctagaacttcctctgtagaccaggctggcctggaactcacagagaccttcctgcccctggctcccaaatgctgggattaaaggtgtgtcaccactgccacctggcaaccgaaaaattttaaaggagctttgaaacaaagtcccattctataacccaagctgagcataaactggtcctgtaagtcaagttggtcctaaacttgaaccaatcctcctgcctcagcttctttaatgctgggattacagacatgtactattacatctttcttttaagtagaatatcttatgtgcaaacatcctgaccttgtacttgatgaactaaagggttgacctcatcatcttgtataaatgtcctgatctcttacttgtagtatgagaaattttaaagagaaagctggcacatatatttcttaagccattcctaaatttaatgttgtatctgaagtctcctgtgagtccaaactgagcattggatatttccaatactgcagtcagggtaggggtagagagctgagatagaaggatctcacatttcaggccagtgaaatatatagcaaggccctgcctcaaacacaccaagtgctggacatacaggtcagtggtagagttcttacctagtatgtaaaaggccctgaatttgattctcagcccaaattaaagaaagaaaaaaaaaggagtagaaagaaaaaggagtagaaagaaaaaggaaaagaaggatgtggaaaagggagaaatgattttatgtgttagatagtcaatgaaagggaaaaattaataaaagtctaaaacccggactccaaagcccaaatagaaaaactcctaagcttctctgagttcccaaaaggcagctcaacagacaaggttaaacaaaggtccacatgactcaaggccttagacagatatcaaacccttgagctgtgtagacattcctccagtccaaagaggatcagataattatcaattgtagaagtccctagcccaggaaataattaacatactcatttcctctgcagcatcctgcttaattacaccttgcctgaagcgtacaatcattgtcccatcctgtgtaaacatggaagttttataatcttgggtcttccagccctacaattttcccttataaaaacacccctcagtcaaaagtggggagtgtttccaaacgaatggggtccttgctgcagttcctatcctagagtcaataaagaaacctttgtccttgcatttggtgagtcgctctttgttggtggtttcttttgggtttccacaatctgggcacaacaggcaaaccattttattaactaatcttctgacctacataatgttactaaaactaattgtcctgggtatagtgtctaacacttataatctcgtcccaggaggatcgggaattgttattctcagctacatagtgaattgaaatgatgccgtgagaaggcttttattgtagaaataagagagtgaagtcatagataggcattggaagagtccagagaagggagagaaagttgtagtggtatctcatctgtgaacctgcaacaatggtcatgcctttggggaatggttacaggtgcagacgtgacccatttaaggtagaggagcagggaggaagccccttgggtctcagagagcataggggaaacagggtctgcatccttggagcaggaatgccgattattgttatctatgtaagttcattcccaacaaacacctatttatcattcatcttgggtttggtgaactaattgtaatcccttgccttcagaaagtaatacaataaacatggccagcaaactgaattgggtcaagaggaccaagaaccaggtttttaaaggacagagaactgtggggagggaagcaaagcccctggactggaaaggtttagggtaggaggcagggtggaaagtgctgaggagcccggatactggccagcatagactgattctgtgaggccagcatgcactttgttttttaatagccatttattctaagtttcttcagcaccttacattccaagttcagagccagtctgggctatgtaagagtatatttaaaaataaataaatagataaattaataaattagataatttgggccaggcttggtggtttccatctataatcctaccatttaagggatcagtataatttactggaaatgtgccaggaaaagagcaaatggggcagggagcaagtgaaattggtaaaaggactgaagggtgttagcattttcattatgatttaagttattaattgtatttttgaaagatttgtatttgttcttgtgtgcatgtgtatgtctgtgtgtgtgtgtgtgtgtgtgtgtgtgtgtgtctgaagaagcctaaagagggcatcagatactctggagcaagagttacaggtagttgtgaacttcccaacatgtttgctagaacctaggaactgaactcaggaaatctacaagagcaggaagtactattaaatgctaagccatctctccacttcctgtatttacttcttcattgttttatttatatttttatgtgtatgggtattttgccgacttgcatgtctgtacaccacatgcatgcctgttgcctacagaaactagaggagggcatcagatcttctgaaactggagttacaattttgagtcactgtgtgggtgctaggaattgaatctgtattcttcacaagaatattcaatgctcttaactctaagccatctcttgagctgcctgaggtgaggtctcagccatgctgggtgggcattgaactctttctgtacctgggaaggatcttgaactcctggctgtgggtgctgtaattgcaggcatgtaccaccatttcttttattattgttttgagacagagttccactttgtatccttgataggcctggaacttgctatgtagatgaggttggcctcaaactcacagagatccccctgctctgattccccagggctgagatcaaaggtatgcaccactatgtccagcctgtaacaccattccattttatgcggtgataggacttgaacacagggtcctgggcacgctaggcaagtactgtgctaactgaagtacatctccagcccagcatataaattttgtaaagctttcttggagaaggagttggtcaacagatacttttgggtaggagttatcaagattgttatgagggataggaaggaagggtggggttggggcaggaaatagtgtcaaaatttccttgataggctaagtaagtattgaaagaaagaaaaaaaagctgtggttttatctttcctgaacacaagggtctgattagagctcttgctgaaagacatcctgttttgcaaattgtaagttattttccatttctcaatgctgagagagatgagaagaaattgtattcttaaaaaagaatgggaggttattttagtaaaaagataagcatccaaaataaacaaacaaaaaatgaaaaaaatataaacaaccaaaaatgttcattgttttttgtttgttttgaaatagggtctcctatgtattcctgactggtttccaacgtacagaaaacctctctatctatttggcccagctggaccaaatctttcttgtctctaaaagcaggatgctttcattagatggactagttgaaacttgctgaatataagatgtcttccacaatgattctatatactctaacttcactataatgagtccttgtgcttgctaaatgacagaccaatgccatgacagttgacaatagccataatggcaactgaaaaggagtgaaaagaaggggcatttgaattcccatgaaatatcctcttattcccctactccctgaaaaaagagaaaagaaaatgtgtgcacactctttccagtcatctatcctttaatctcttctatttaagtctataatctctccacctccagtgtattgagaacttgattcatgagagcatttcccatatatttctgttactggccaaaagtaaaaatctcctttactgaacaattagtactcagttttgttactttttctataaatcagaggaaggaaaagggcccaggtagaggtcaaaacatagcataagttccttgaaatcagggatcatatattgttccaattttgaactttaaaggttcctgtagttatttctacacagtaaatattcaatgagctctggataaatgaataatgagagagtgaaaaatgatcttaagattccttccaattcatgtcaagagcaagagccatactaatatagcctagtttactattataattgttctattttattattatttttatgttgttagcttattgtgcctaatttataaataaaactttatcataggtatatattgataggaacacaaagcaaatagaggacacagtgtagttacgaaggtctgaggctagaaaggtctaacatggtggataaatgcaagttatgaaggtctgagaatggaaggtataaaggtctgaaaatggaaggtctaagatggttatgtaaggtgtatgaattaaagttatgaaggtctgaggataaaaaaggcttaagtgatgataaagtgagttgagacattaaaaagaatgaaatatgttcctgatttctctatttctcatgctactgttcatagtaaagttctacaataccactataggatcataactacaaggtcaagattaagatgcttttcattgtcctaaaaaaaatctgtcgattttaaaatggtaatgctttcagccaagttgcttctaataagaatatgctgctaatgtttctaatacttatgtttccacaaattctaaggattcttgtaagttccagggagctgaattggatccaaacaaacaggtcagattcactccagttattcaatctttccctggtcccaggactcccttccctcatgttgggactcttcgggaatgcctccctcatcttataatcatcccctcaagtgacaggacctaagaaaaaaattttttttctaaacttaaccttgtcctcggctgccaacatcttaacaagtctaagagacgccagggagttccatacagcctggactgcgatgaaacaaccagctaccccatgacgtggcagcaccccaaccttctcaggtcccccaaagatggtcaacgccaccccatgtcagtaggaagcagtcttgagaattcgatgcccttattccttaacctgccatgtctaacatctcaccctttttaataataagtagaggtgggaatgaaaggttcaggctttaatgctgatcagcaatatctctttaagagacagagcccgccccctgacaacagtcagggcacacacaggaaaacatactacgtcattaccatatcacccaccacgcattacagcctgcatgaggactctgggcatgcatggaacctcagtgcatatgtgcagtcttccctttaaaagttccaacttccctgctgctctctctctactctctctctctgcttcttcactctgctctttgctctctctcacctacgcactctctctctgcctctctgtggcaactggccatggtggtcagccatttgctctctttctcttcttctttagtctccctactctgctgggcctataataaactagtcaatatgtctcatcttgccccttcctctttttctttatatctaatttaaacaaaaacataacaactggcatgctgattgggcacaagattgttaaattctttcatcaggctagagaaatggctcaatggatgagagcactagctgctcttcaagaggacctggctttgattcccagcatatagatgatagctcataaacacttacaattccagttccaagggaactggtaccttcttctggcctaccttggcaccaggcacatatgtaaagaatatcatgcaagaaaaacattcatatatgtagttgtttgtttgattttttgagacagagtttctctgtttagcagcctggctgtcctgtatctcattctatagatcatgctgtccttgaactcacagagatctccctgcctctgcctcccaagtgctgggattaaaggcatgtgccaccactgcctggctaaattttttgaagttttaaatcctcctatgacaaaaaactcctgtcctcttgacctagttaccaaaagcaacttgaggaggaagggtttagttggcttacatttccgtatcattgttcatcatcatggagggaagtaaagacaggaactcaaacagggaagggacctggaggcaggagctgatgtagagactatggaggcatgctgcttactagcttgttccctgtggcttgctcagcctgctttcttaaagaacccaggacaactgactgtggggtccccccatccactatgggctgggcccttccccatcaatcactaacttgtgcctacagacttatctacagcctgatcttttgaacatattttctcaaccgaggccaacacgccagatcagaacttgaatccatcccaaactccccatctcattggcttccgtctcaaaacctcatctaataaaaaaaattgaggcttgaggctacccctccccacttcaaatacttgagtcagtcatgtagagctttctagctctcaaggtcctgagacaagcagatgccagctgccatctagaggagggaggagtgcctcctgtaactccagtaaattctaaacccatcttgggatggtttgaatgagagtgactcccataggttcatatatttaaattcttgttccccagtaatagaactgttttggggactattaggaggtgtggctttgttgaagactataaatggagttcttaattggtctagataataaaaacccagagtcagatatagagagaaatactgagagatcagagagaaggagcaagacacagcataccttacctccttagcatcagcagataagggagtaatttcctgtttctccctgcttatatcttgtttctgcccaactacctcacttcctgtctatctgtacagacctccagacctctatggttagttggtggcaaatttcattctctgacccccagacaggctttatttgtacaagcaagatatcaccacagaagaccactggaggtaataagctttgaagttttaaaagctcaagtcaagccaagtctttctctctgcctccaacttatggataaggatataagtatttggttgctgctctaaggccatgtttgcctgcctactgccatatttccttccatgatgatcatgaactctaaccctctgaaactgtaataaaacccccatttaaattatttattttggggggagggggttctagacagggtttctctgtgttgctttggagcctatcttggcactccctctgtagacaaggctggccttgaactcgcagagatctgcctgtctctgcctctgcctcccgagtgctgggattaaaggcatgtgccatcaatgcccggtaaattctttcttttataagttgtcttgttcatggtgtctcttcacagcaatagaaaaataactaagacatacctcatatagaaaatggatcatagcaatctatttcttacagcttaagtttgtttccacagccaaatgctctttacattcccaaaactaatgatatttgtgcccttttgtattacctttgcacttcttcccaattatcatatttctaagcatcagaactcgggcccttctcaaaccggtagatttgagtgggtgtagataatgtctattagtatcaactctttgcattaatccaagtgtcacttaagctgcaaagatgactcagaccaaacataatactaagaacatgctttctatcatatggaatactaaaattacccaaccatcctcccagtctttattgatttcttatgacctgaggacaggagacgatataggttccagtctttagaataccactgggtgtggtgacacacagctgtaatcttagcacatggaggcagaagcaggaggtggaatactcagactatcatgagccaaacaagagtcttttatttaaactagtaaccaagagtgagctcccaacacaaagaactctttgtcacaaagcaaagcaatacaaggtttagaaaggtaaaaccaggtatgggctaagggaaattcacaagtactctttctctgcaatgaaggaggaattctttgttctgtcaaacatttaacaggcatcatttttcagaaggaaagagggatcatttgtttttgttaaggaggaaggaggtatgaagtcaattatgggttcaggggtagcctgacttctcctaggtcatttcaaaggatttgtgaacatttaagccaggctggtttatactacatagcttttgtaggatttttcctagggagatgtgaacaaatgtctatccatcccagatatggcactagtgactgatcatataaatgattccatccaagcctacttaagttgaccaatgagtttattgtagttacttacaggaatatgggtgactcaaaggccactgcatcaaagaccatcctggcttgcatgggtgaccgttcacaaaagctgcctccctggaatttcctgaaaggcttgtagggagttgcaccagctggtgaatttcttctttctcataattgttactgcttatacaactggggtgtgtgcaactatatacataccatggtgcacatgtgcaggtcagaggacaacttataagagtcagttctctccttctaccatgtgggtcccaaggattgaactcaggttgtcagacttgatagcaagcacctgttgagtcatcttgctgaccctggtttcatgacttttctgagtcttatggaccttcttccttccaaagagaatgtttcaatttggaggaaggggctatacaacaataaggagaccctgtcttcataaattaataaatgaagaaagaatttagaatatcatgaaccaaaggtggtcagttaaaaggttagagggaaaaaatgaggaaaaagacaaaagtaacattctgcccactttgttggacttgggtttcatcagtcttttagagcagatcacaaagctcagggaaagacctgaattccatttgttactttattataaaggatacatgtaaagagatacagagggtaaattatactcaaatatatccttactaaacacactaccttccaagaacttccatgtgttctgccacttggggtttcctggaactccagttgctatgtgtttttatgaaaacctttttacatagataacactaatgaaatatctgacaaatgatgattaacagcctctctcttctttgggaaggctaagaagtcagaaagattctgacccattaccctgttttagtctttcttgtgaccagctcatcctgtggctctgtggggtctgtcagacatcagcccaatgaatagcactgtggtggctatttttgtaccaggcatccattttaatagtcctctgacctaaattcctgaaagataagctcccagaaactgcttccccctccctagaatagtgtaacagttacgaagtgattaacagctcactctggtttttgtaaacctgtctatcactgtggacagtggcagtgagtcaatccctcatatagctgtaaactccccagaaatgaaatagttgtgtttttttttattttaaaatccctttcctcaactccttctgggagtaatgccttcaatttgccataaggctgttgttctgctaccagtgttaataaattcatctgattatacgtggatttatattggtctttttcctaatggtcttgaactctgtaacagcacacagtaaaaacatacatatcattgtgaaaaattgaaagatttggggaattacatgtgtggaaacagggaagaaggcccaaatatatattagacaaaaccacagtagataagtgtcttagtcagtgttctattgctgtgaagaaacaccatgactacagcaactcttataaaagaaagcacttaagcgtgtctggctcatagtttcagaggtttagtccattgccatcatgtcagggagcacggcagaatgcacacagacatggtgctgtggaaatagctgagaattctatgtccagatccacaggcagcaggaagaaagaaaaaatgggcctggcttgaggtttggattcctcaaagcccaccaccagtgacgcttactccaacaagaccacacctacttcaacaaggccacacctcctaattcctctcaagtagtgccactccctgatgaccaaacattcaaatgtatgattctatgggaccattcttattcaaaccaccacaacatgtgtgagagtctgtgcaaggaagctatgaacttactatgaactatggatggggcagggtacaaaatgttcttcccatgaggttctagaaaaaattgcatcaactatgacaattagatgcacttgaaagcaaggacatgaaagggaatggccttacatattcacattatttctatgggaaaggtgaagtcctgggagaagtactcttagctctttcacatgaccaaagataatatcataaggcataataccaggtgtatccctttactgtgcttgcatttgcttaagctaactgtaaatatcacctcgtgcattgctttctttaataatataaatgagaattgttctatttgagcttcttttgtgttcaaatgccttaggcccactgatacgctactcctgttcagatcatagactcggtggcaagggtgggtagacagacacagaataaaaaaagaaggaacaaagagtttagctaagggtggggccatatgatttcagtctcaacactcaaaagtgcagaaggatgccacaaattccagcttagtctggcctgttaggtgagaccctgtcttatatcccacctctaaacatacacagaggaaaaaaagggaaatggaagaagcagaaagaaatagagagagaatattaagtagcctaatgttagaagtataaatgaatcaaattgaagacccagacataaattcagacacctatggacacctgacttttttttttaataaggaagccagaaataaacaatggaagaaaaagaaaacatcttcaacaaatagtactggtctgactggatgtctgcatgtagaagaatgcaaatagacccatatatatcaccctgtacaaaaaactcaagtccaagtggatcaaagacttcaacatagaaccagacacactgaacctgatagaagagaaatcagggaatagccttgaacttattgacatgggagacaacttccaaaatgaaaccctgatagtgcaggcactgcaatagacagtaacagggcctcatgagactgaaaagtttctgtaaggcagaggacactgtcaataggacaaaatggcagcttatagaatgggaaaagattttcagccattctacatctgccagagggctaatatccaaatatataaagaattcaagaaactagacatcaacaaaataaatactatttaaaagggaggtacagatctaaacagagaattttctttctgtgtttttttttttgtttgtttgttttgttttgttttttgtgggttttttttgttttttttttttggttttttttttttttttttttttttttggtttttcgagacagggtttctctgtgtggctttggagcctatcctggcactcgctctggagaccaggctggcctcgaactcacagagatccgcctgtctctgcctcctgagtgctgggattaaaggcggagaattttctatagaggaatttcaaatgactgagaaacacttaaagaaatattcaacaccttagttattccatcttatatctgccagatggtataatgtcacacaagtgacagctcatagttgctgttctgcaggagctacagctcgttcctgcaaaagccccatttatctctctccaaaccctaccctctcagagaatctccattggagaagagctgccaaaaaccccagtaccgcatcttggtggctagtagctcctcccctgaatttgccagcagcccaagacaccacctaaaagcataccgtagttggacacaaacccatgtcgtcactcctcgcctacaggatacataagcgacccacggtagatgggccatgtgattgtctcctgtatccatctctgggggttggcagaatcacccaggagttgctttgctcaaaatgtacctgttcttttactttttccattctgcttgatctcacttactgtattggctgagaaacctattattggggcacagaaaacctatcagttccaaaggtatggagccaggggaacactcctcgatgctggtgggagtgcaaacttgtatcaatataacagttcctcagaaaattgagaactgatctacctcaagacctagctatatcactcttgggcatatactcaaaagatactccaccctacttagggggtccctgcaagtttcataccaggaagcaaaccatgtgaagagataagaatgagaacctggtacagactgactttgtctacctggctcaaactttggagagtctaataacaagcggtttattcccaatgtattaagcccagtatgattttagaaaaaacgttccctgataaaatgcaatccctgttgcacaaggaattataattacattgaaattcaactcagggtacacatcatttcttccaagaagatggttctagagataggctatttgtactaacttaagggcctaagggcctaagggtctggcctggtctcagtcatacagataacatagagatcatttgggctattagccacttctggtcctggttgtgggagcttggatgagcctctggccataagggtcatttagattactagttacctccagtcttggttataagagtttgatatggcctggcccaatagataacatagatcactaatcagtcaatcatttccaattctcagctttctggatggaagaacaggtttttcatctttctcattgtaaaaacaatcctgtacgcacaaggacctttgtgctatgctcccaacaccctaccacaaggacacttgctcaaatttacccaaatatgctcatgatggctttattaacaatagagagaaactagaaataatttagatatccctcaaccaaagaatagataaagaaaatgtggtgcattttacccattggaggattactccactattacaaaaaagaaaggaagaaagaaagaaagaaagaaagaaagaaagaaagaaagaaagaaagatttgcaggcaaatgtatggaactagaaaaaaaaatccatcctgagtaaggcaacccagaaaaacaaacatatgtactcacttataagtagacactagctgtgaagtgaaggataatcatattacaatccataaactaggttccacagacccagggaggctaattaaccaggagagcttaaagagggatgcaagtgtctccctgggaaggagaaatagtatagattttgtgggtagactgggatcaggtggggatgggaacaggagggatcaagtgggggatggagggaggaagggagtatggagagagatgattggaataggggtaatttaggggtgctatggaaaaagtacagtggaaacttcttggaacataattagagtatggactagcaaggactgctcgtcatggagtctgtaccagccatcttctgtaaccaggcaaggcttccattggtgggaccagccacaaaacctttgacccacaatctgccctgcccacaagatgtggtagggaaaaggtggctcagaggtagaagaaatggacaactaataactgatctaatttgaggcccaagccacaagggggagcccatgtctgatcctgccctgatggccaggaacaggagggaaactgattagcccagaggcctaaggtagaacggaatatgactgaaaaaacaaacagaaaacaacaacaaaaatcagatgtttcctaatgatattctgctatattcatagatgagtgcctagcccaattgtcttcagggaggcttcctctaccagttgatgggagccgatgtagagaccagagcctgttaatcctaaaattttccagagaaaaactaatcccaccattttgaaccgtatttgaagcaagttttattaaaatattaaaaattgaccaagatggacattggtcaggactactcgctgtaatttcccagctgagtggccctgaaacatgtgctacagagttacttaaggaaaaacccacatgccattgtattttcccatgaggctttcctattttttttaagaactacaactcccaaaatctcagaagttatctggtttttggacaggtggggcttacaggttaacttgtggtattacaagccaaacattaggcagagctcagggaaccccaagaaaggaaaggaggaagaattgtaggaatccaaggtgttgaggacaccatgagaacacagccagtagaatcaactaagtagggctcataggggctcacagagacttaagcagatcacagagtctgcatgggtttgtgctaggtcctctgtatacctgttgtggttgtttagcttttggtttttggttttgctttttttgtgtgtgggattgggagtgtcagtcttttttgcttgtttgtaggatccttttcctccaactgtgttgcctcgtccaaccttgatctcagggtttgtgcctggtcttattgcatcttgttatgttgtgttcagttgatatcccagggaggcctgctcttttctgaagggaaatgtaagagcagtggatctggggcaaagggaaggtaatgggggaggctgggaggagtggatggaggggaggctgtagttgggatatattaaatgagagaagaataagtacaaagaagaaaaagaaacataagtgaaactattttatgtaaaaccattctgtgttactcagaataatttaattcttgcaagatacattaatgacccagcctcaaggtggctttgatatgtttgatatgttaatgaaccaaccctaagttgtgaaccttgatatcacaaaactaacgcccactggacaatacaaaaggcaggcactgctgggctcccaagatattgcatcaaaagcctcttattgagttcacacataactacctgtcagcatctgtcagctgcctgatgccctcaaaaaccttctagaacttccaaagtgttgaggaccaaataaatctgttatggaatgttttggggcccagcctctagctcctgcaaacaggaacacctgaaaactctggcccactattgtattgataaagccagtaaggctactattgtttaccatggcctcagggtaaatgcctcctattttcatctctataggcctaagcatctgaataggcctgcacctgggccaaggtgcaaggtgtgtgagtgactagggagtgaccagaagagagaggagaacaaagagaaaaatggttccctcctggtgttggcaggacggttaagaaacagcagaaaagatggctaataaagaaatgactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgtctcaaaaaaccaaaaaaaaaaaaaaaaaaaaaaaaagactctagttctacaacatggaactgagagctctctaaagatgacaagatgtctgtgtttggtctttatcgccgctgggttgctaggagcttccaggtccacacccccccactcagcccgaacctcatggattaaggctgagacacgctgggtcacgacaccaaagaaaactctaattccccaaacttcaaaaggcagtgaatatgtccagaaatgacagtcttggcatagctaaagctgcactgtaggactgctaaaagccaacagccagcaaaatgggtttctgcctgccagagagagacgcttcccttggaatttatctgtggttgcatatcaaagctcatgctggcctctatgctccttcagtccctgttcgaacatacttgttacacattttgaagttcatgctagtctcctaacccttcttgtctcccaaactctaaactccacttctactatgctaccctaaggttgttgcagttcacaggcttccctcctcccagatacctgcttattctctatataaccactaccaccccactctaatattttcacttcttacatagatagatagtcctgaccatgtccagtctaatccccccccaatctattggactccttccagatacctctggatattctctcttttatcaacaatcaaaacttctccacaaatcttggagccaccacctccatgatttctttctgcaccctcacttatattcccagcctgccacagatgaaggatcttatagtggatgcacattgctcccaaagcatcttcaccaaagagggttccccccggtaaagcctgcagcatttcctgccattccctgctctggtgagatgtctgttttgatgagattaccataaactttaggatggcatggtattgtaagcaatgttttatgagaataaaccaagaatattcagaaggcagacatcatgtggacatcctagttgccaagcccctcaaagcccaccagctgagctcaataaacctaacatatatgaagcccaaagtttgatccttggcaagaacggtggtgggaaaccaagtagcctagaaataaaaaggcatactgtcttagtcactgttctattgcttgccccagccagcagggctgcaacaagagcccaaacctcaaaggacctggaatgaataggaacaagagacacaaagaaggcacaacaagacagggtttctgatcaagctgcaaatttttatttttctcagagaccttatatagtggttgaatcaggaagctttcagggcagaaactcggcagggagaggccatttgcctgataaccaaaccacagaatgtccctgtgagtgagtccttgaaggcaagcagagggtacagggtgctagctgataagactagttatgttggagagtatgtaggaggaagggttgctaagtaacctgaccttggaatgtttcttttctattagctaattctgtaaactcaggtgttatttatcaggaatttgtggagggaaggattgattgggactaaaggtagccattcttttaacataatgagctactttcaaaactgctgacaatcttcacaagaggtcctatacagcaatgatggttcctggcatagctattaagagacactatgaccacagcaactcttataaaaagaaagcatttaactgaggcttatgtatagtttcagaagtttagtccattatcatcatggcagagagcatggcacacaggtagagatggcactggagaagcagctgagagttctacagccagatccacagacagcaggaagtgatattggatctgacttgggcttttgaaacttcaaagcccatccccaatgacatacttcctccaacaaggccacacctcctagttcctctcaaaccacagtgcctcaccctgataacaaatcattcagatatatggacctatgggggttatattagtcagcattctctagagtcacagaatttatagaatgaatctctatacacacacacacacacacacacacacacacacacacacacacacacacacacacgaatttactggaatgacctaaaggctatagtccaacaataaccagctatgaatggaaaatccaagaatctggtagttgctcagtcccatgaggctgagtgctgttgggatccagcccccacggggtctctaagagttgttttccagcataaccataggtacctcctgttttcctaacctcaccccactaggatcaatatcctgttgacctggggtttttgtaagtttgtatataagacttttccacaataaaggtgggagacattctctcagaaagtggaccaggcacatccaaatctccaggctttcgcccgatacttagacttagtggtggccaagtgtggccacagggtgcctcatctggtctactgtatttgctggaatcctaaaaatgtaggctccaatgccagtgaaggaatggatgtgctgacaaggtaagggcaagcaggcaaaaaagaaccctcccttcttccattgtccttatataaccttcctacagaaagagtggcccagatgaaaggtgtgcctttctgcctcaagatctggatcacaagtgtgcccactatttctggattgtagttcattccagatatagccaacttgacaaccaagaatagccatcacaggggccattcttattcaaactaccacacataccgaggacctgacagtaaaagatatgagtctgtgtctcctttgaagttttaaattaattatataattctgtggttcttcttactgaacttggggtcatagtctacactatggcttccccaagaagccagattatatctttttttttttttctggagaaagaaatcaattaaaatagccaaatcaatagaaaaaaaaaagaatctgaaaaaggagacactgccgacactgttaagagagacaaagagagctaataagcacttccagtccatcttcagggccctgaagtgagattaaagttaaataggggcttgggatatgtccatctaagaagttctggttaatgtgtggtccttcccaccatgaacccattgaaagacccccagaggcttaggcccccaggatctcaggatctcagcccaggaccgaggccaccccaaccaccaggcagaggcaaaaacttgatgcaaacagcacgaggctttattgtagttgtttaacaagctaaccccatgttagctcaggcctttcatccatccaccatggcagatggctgggaaagatgcctccaagccatggcatggagatcttataggacagtgtaaggggcgtgtctaggggtacacacaggctcaggattggtgtgcctccaggcttggagggtttaccttttgttgattggtcaactggttgttatggcccataggccctcccagggtggttgctatgctctgcacgtcattgctgtgtacttgtccataaagcacacccagagccgtaaagcatagcactaccagctaacttctaattggttccttgccacgaggtaggtatctgacctcctagtgaccaaggcaaggtcaggcaagcatgtgttaggctgttaaggctgccgagctagacatcggtggcacacacctttaatcccagcactcaggaagcagaggcaggcggatctctgtgagttcgagaccagcctggtctacaagacctagttccaggacagcctccaaagccacagagaaaccctgcctcgaaaataaaataaaataaaaataaaacaaacaaacaaacaaaaggctgccgaaatggggagctggtcccttcaccatcagtttcttggcttccatctctccaggaaggtggtctgacaattttttgtgtgtgttttgtttggttggttggtttggttttttgagacagggtttctctgtggctttggaggctatcctggtactagctcttgtagaccaggttggcctggaactcacagagatccacctgcctctgcctcccaagcactgggattaaaggcctgcgccactactgcccagctggtctgacaagtttttattcttgtatgaaacctttctgaaagaaaagtttccactctgactggctccatgcttcagcattttcctcctccaagcatgagattcttgggaaaaatgaggctactggtgacatatcccccatccatataatggatacaccttaattaactgtgagggaccaaaaattaaaattaatcaaagtttaaaaacttaggctctgaaaagggaatgtctaatggaaaaagaaattttaactccttaaatcaggagtgccatggctggtgcctgatcccctgctctcagaaaaggggaggtaactgtccaccactcctgttaacattcctttgctaattgctggtcataaagatcccccagcccaagggataactgacagacactgtgactctgtaaccctgcaagcccatgccctgacttatctcagtcaaatgtatctcccttaaaatgtttagttactgactaactctgtacattgtgtgaccttaagtaaccatggaaactgtaatttgtggccttcaaccttatggtctgcccctttaaaagcttctctgtttggctggttggcatctcatttgcccaccatgcagtagaacctagctatccagattgaaataaaaagaaaccttttgcttttgcatcagagtgtcaactctttggattagtgtctgggatccgagaacctggcacaacaaaatgtatccatcctccctccatcctctaaatcaaatagcaccacatgttagattgttgggacccttttggggtctgctgatcatctgtgactaagggtgacccattgtgcccctggggtctgctgactgtcttgtgactaggtgtttactggggggaggggcagggcatgaactgaaagacccccctagcagacagagtagggcctagaatataggtgggttggttcaataactctgttccaggaactggctgaccacaaaagttatagccggttcagcaactctgttccaggaataggctaaccataaaaagttaggttagaatcttgtaaacgatcttaagaaacagggagtttccccttgtgatttccccttgggactttccactggtattcttggtatttttcagtaacaccctccctacccccttgcccctttgggctgtggtttcttcctttaaataccccttctcccagccattcagggtcaagctcctctacccctgcgtgggatatgagtctcggccccagcacgctggttcctgttaataaacctcgtgagattgcagcaaggactgtctctcctgagttcttgggtggtcgtatcatcccaagacttcagtgagggtctcccttcttagggggtctttcagaacctctgagctgaataaaattccactgtggctactgtttggtatggaaatctagtcccctttgaaataaatggcattctccttgcaagaatgaccagctgtcttgtctttatcaaattcttagattccctcgcccaaatctgtgagaagttgtagtgtgggcattacaatattagattattttttaagcagctatagagaagagaggacagaaagaaagagaagcttggtctgaccttatgaggaccaagagaacatcttgtcactcacatgtaaggatgccctaaatatctacagaggaagatgggattatgtcttttactggagtggaaagtagtctgcaaggtaagctgggaagtgtagtcctccagtgggaaactatccagaactacacagagaaacagtttctcattccccaccccctgagaggggggggggacacaccagaaggaggaggaaaacttggctctcacttcctgcttcccttttactttttttttttttttttggtgtttttttggtttttttgagacaggatttcctctgtgtagctttggagcctatcctggcactggctctggagaccaggctggcctcgaactcacagagatccacctgcctttgcctcgtgagtgctgggattaaaggcgtgcaccaccaatgccaggcacttttttttttttttaatttccttcttttctcaccccactcaagggacaggacctagagacttgtacctaccaggaaggaagcactctattatagaattctgttcccaggttttttgttttgttcaaagtttgtgaaagcatatcactatgtagcttattgatgcaaaaaacatagctctcatcttaaaaaggaataagggatagtttattctcaaaccatttttgaatgatcatgattcacaaaattcacagattaggttaccccaaattccatgttccaatgtggaagcagttttacaaagtttttatagttgaatggagcaaagaaagtcataaatcaaggtatggtgattcccttgcaggctttacagtaggcaggatgagaaaatgatccacagagagacaagaatgaaactcagctcagtctgattttattgtagccagtgctggacaaggacttctagaatatggcccagatcactttagccatatttaagcacagtacaattttggaaaaggtattctgttaacagttaactcagtcccaagtacacagcgatttaccacatgttcacattgagactccttacaaagtacatctggtttcttttgtaagaatgggtactgttgactcagagatagtgcccaagatttagggtctagggaggttgactgaagtaaacataatgccagtgagtgttaggattggcctggccctaagataacatagaagtcacttaggctgttgtaaagtacaagtgacctcactcataagagtggttttaaaaacaatgttcaagatttagggaaaaggatctctgataagttaaaacataaattctggaagataaggcagagcttgtctcatcagaccgcaaagatcaccaggatgtaaaacaacataattcctaaagttccagcaagagcagcttcctcacctcattcctctgaagaggttgaagggacctgctcccctttcggcagccataacagctgaacacgtgcttgccataaacttgccttggtcacttagaggtcagatgcctgtctcgtgacaaggaacccatcagaagttagtcactagaaagtcagatgcctgccttgtgacaaggaaccaatcagaagttagctggtggcgctgtgctttatgactctgggtgtgctttatggacaagtccacagcaatgatgtagagagcatagcaaccaccctgggagggcctatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcaagctctcgaatctgcctggtgattggggtgaccgagaacgtggcctgggaccccgggtacttgagttttccaggggtctaacaaggtaagctgtgtgttaaactcttctggcttccagtgcttttccatgtgcacaaggctctttgttctctacatcaatgtaagtttaaaatgaattggtgggcccggtgttggtggcgcaggcctttaatcccagcacttgggaggcagaggcaggaaggtctctctgagtttgtgaccagcctggtctccacagcgagtgccaggataggttccaaaactatacagagaaaccctgtctcaggggggaaaaaaaaatgaatgggtgggtacaccagaaaggcatgtatatcaagatggggggaggtattttataggcctaagaagctctctgatgatattcttagtgtgatggctaaagaactccattttatgctaagcatccattttggtactcattagccatctgtatttgattccagtctcgaatagataagttcccagtaaccctgactcagtgatccctacccaaaagtatacagctatgactatctatttatgatattgaagggactagctccccatttcggcagccataacagccaaacacatactcgcctgaccttgtcttggtcactaggaggtcagatgcctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatctctgtgagtttgaggccagcctggtctccagagtgagtgccaggatatgcgccaaagctacgaagagaaaccctgtctcgaaataaattaaataaataaataaataaataaataaataaataacctcttgctgtttgcatcaagttttcgcctctgcctggaggaagtcctgggccgaaatcctgggggcctgagcctccgggggtctttcaattaagctagatgcagattattttggaaaagaaaactctcttaggatattggagacattgccaggatacttctaaagtatcctttttacacatgttcctttattcacctcatctttttttctaaagaagaagggtctaatcctaacataaaactatctacaataagaacaacagccaggtgttggtggcacacaactttagtcctagcactcaggaggcagaggcaagcagatctctgtgagttagagaccagcctggtcctgttccaggacagcctccaaagccacagagaaaccctgtcttggaaacaaaacaaaacaaacaaacaaaaagaacaactatcaagtattgcacagaagaaagaaaaggtaataacataagcaaaggtgaaactacaaccagcaagtgtcagaagccagccttggcgacctcccatgcctagctagccgccagccagtctagcatcccacccctcaggttcccggacctggcctgagccgcaactaacacctattccttcccccgcttccttaacacaggggattccggatacctgcctgagagcaattaacattcattcctccccccacctcccttttctctgctttctcctttctctttagaaatccccttggtttcaataaagttggccttgacaagaaaacctgcttggtcccactctttctttcctgcccattattttcaggtgtgatccacctcggactcacgaattaccagagacactcaggacagggcaagcaagaacaacatcaaggaagaaatacattctaaatgtccaggccataggttactggcaaattacagagagtattctaatagctcttctatcctggagagtctaagtcttttacctaatatgccttggctaaagtgtgagaggattgtaactgtaactatctaatttttaaacccttcaaagacctgaaaaggaaaataatattacctgagcaatcaggaagtgcaagcaagcaatttccaaaagaagcaagaaatgacagaaatagctggctgcctagacagtcacccaaagtctgtctgtaacactggggcaaccaactttggatataggtctagaatatctgacagactattttcagaagcaggaaaattcgaaagactctcctaccctatcttggcaaggttcagcagttgtttttccctgagtcctgcttatctggattggacattgtgctactgtcaagagtcaagtcaagggcaggtctttgcccaataggccagttttgccaagaggaaaacaagttccttatggagtgttttctgtgccaaacatcatcttgggagtagattggtgcttctagaagtggtcatgactcacacatcaacaactgcaaaaaactgtttcatttactagagacatatgctagagcattgccagtcttaatttgtacaggtattcccatgatggccataacttctcacaggtgtgtaataaaagaatcagcctttttagaatcaaagcagctgcccagttaaatcttgaaaatgtatctattgtatggtgtacatattttaatttttcaaattctgtgaaatgaaacatatccctttgccaaatttcatttcttggcatacctttagggttactccatgtaggcaagggagtctaattatataaggaacaagtagttgactcgctatctctgagtcaacagtacccattcttttttctttctttctttcttttttttttttaacaattttcttggcttgttgccaagtgattgaaaaatcacttttcaaacctttggtgctaatatgatggttttttttttttatgaaattttgaggcctccagaacattttctattaataacatcaattccatcattaacttgtgctagaggacctggcagacctgtatgggatctgatgtgtgttacatacatctgatgatttctattcctgactacttcctgtaattgtataaataatgaagttaattctgactcatcaggaataagtttagtggtttctatatgtaaaataactctgtatattgagcatcagtaactatattgagaggttttataaaatcaattagtaccatgaaaattccatgcaattttgacttttgcacagaattatgagggctttgagccactttgcttagggtttctgatttgtaacctgccttttctgatttatttgcatcagtataaaacctaggggatccagagattggtgttccccatataatttgaggaaggatccaactggttctttttatgaatttaagtttcttacttttgggataactgctgttaatgtctcccccaaaaaaattactgtaagctctttgtcagttttcatttttctacccataaagaggaaatcttctctttattaaaaggtactatgatttctgttgggttcattcctgtcagttgacaaagtcttaattttccttttagaatcaaatcagaaacccattttcacatatatctttaatttcttactctgttggtgttgctaaaaatatccattccaagacaatatcttccctctgcattaaaatccctgtaggggaatgcttggagagctatatgtacagaatgcagttaagcttcagatccacatgatttatgtgggcattctgtaatttttctttcaccaaagccaattttctctcagcttctgctgataatttctggagtctatttaagtctttgttaccatctaaggtatggaacaaattatgcagtttttatccattagtttttatcccattagtgggccatagtttggagatgtctcctagcaatctttgaaagtcattgagagtctgcaatagatgtctcctgatttataacttttggggtcaaatttttgtaggcataatttgatattgtaagtaatataatagaactcttctttgtattttttaggtgaaatttgtaattcccaatgaggcaaactttcttgtttctttaaacatttttttcaaaagtatccatttttgaatcagctaataaggtatcattcatataatggtaaataatagatcacagaaactgtacaggaattattttgcacaaaatattggcacagagtcgggctatttaacattttctgtgggaggaccttccattaatatctctttaactgtctcagagttgttataagtaggtaccatgaagacaaatttttccctatcctttccttgtaaaggtatagtaaagaaacagtcttttaaatctataactataataagacatcctttaggtaacagaaaaggcaaaggaattccaaactgtagagagcccattggctgtatcaccttattaatagctcttagatctgttaccattctccattttccagatttctttttaataacaaatacaggattccaagggctggttgatttttcaagatgttgagcatttagctgctcctgaatcagctgttctaaggcctatagtttctctgatgtcataggccattacccaacccaaacaggtttatcagctaaccattttaaagttacggctgttggtacctctggaagatcaacagctgttgtgccctattagcttgggaggcagagggaggtggatcactgtgagtttgaggacagcgtggtctacagagtgaattccaggacagccaaggctatactgagaaaccctctcttgaaaaaccaaaacgaaggaaagaaaccatttagcagtaagagagttcaactctatcctgagtcattttagtgcctaaaacataattttaggcacagggtgttggaactcaacatcatgctgaccccaccccctgacaatgggtgggacatgcacagtggcatggctacgtcattgttgtgtcactcattatggggctgcataaggactcagtatgcatgtgcaaacttccccttttaagtgagcacctccacgtggtcactcttcactgtcttctcccttctctcttgctctacttcttcatatctctctctctctctctctcttgctctccactctttaataaactggttaatgtgtctcttctgttcatgtaccatctagcttgatcttaaacaaaagaacaacacaggtgcctaaaaaaaaaatcaataaatagatcaggcatggaggagcacacctttaatgccaatttccactgactttggagtaaaaagcagaagaatcacttgagcctagaaattgtagcccagcctggatagcacagcaaggtcctgttttaaaatgatttttattgtttaaattttaagacaaggtctcatactggccttaaactcactatgtagttgagaatgaccttgggctcctgattctctagcccccacctctcaagatcacaggcctgtgccaccatcattggctagcattgtctggtttttgttttgttttgtttttcgagacagggtttctttgtgtagctttagagcctatcctggcactagctctggagaccaggctggcctcgaactcacagagatctgcctgcctctgcctcctgagtgctgggattaaaggcatgtttgtttttgtttttgtttttgtttggggggttggttttttcgagtcagcgtttctctgtggctttggaggctgtcctggcactaactcttgtagatcaggctggtcttgaactcacagaggtccacctgtgtctgcctcccgagtgttgggattaaaggcatgcaccaccaccgcctggctgcattgtctgtttttaaagacaccaaaattgggcagcatactgtcttagttacttttctgttactgtgacaaaataccatgaccaaaataacttacaaaagaaagaatttaatttgagcatatggttcaaacagtttgagtctatgatggcagagtgaaggcatgacaacgggcagctgaatcagaagctgagagtcccctatatccacaagcagtaggcaggtagagcacactgggaatggtgtctttttaaaacacaaaacccatccccggtgacacacctcttccaataagacaacacctcctaattcttaccaaacagttccatcaactgtatttcaagtatctcaacataggaaccattcccattcattccatcacacatgcaagcctttcatttcttcctgagaggtctacaagtcagcggataattatgcttcagactggtgcttagcaatttaggctccaaagttctagttagtacagctgttttaaggctcaagctgaagaatccatgctttggtgggcatattgtgttgttcagctatctgaccacaaaagcaaataaagccaggaggcaagtcaagcctgcttagggcctcagttcacattcatttccattctcagtacttcactggccaaagcacaccataggaccaggtctaagtattacctgcccacagtagaaggggaagaagagtgaatatttactgaagaaaaagcaaggcaacaccctaacctttcattcagcactttactatagacagctgatgttcttggtgctgtcattatatgcaatgttatcaatgcacagaaaattatatatatttcttctatacccccttttcccacaaaagggtaatattcaattcaaattcctgttataatgtgttggggcccaaatattggaagtctattccatcctgccacaagttcagagagctcaagtcactcctattgtctttaagatattagcttgacagttgcagaatgtcctggcctcagtatagtgaatggctcctatctaaataacaatagacctaggcccaggagagtttacactaatcctgaaggctaggtgatatgagctgctatggagcacctgatggtagtacatgtgtctttaggattaagggaagtaactgctatctgccctttatacatgataatagaagtcttctgccattgttcccacctctggttggttacttaagattgaggcatgaataaactggacacattcattattaactgattctgccctccagatattatcctatgtctccatctttcctttaatgtctatagctagccttccctcatccatactcccccactcaggaacggacctggggctgtttggctggttccaattgcagccctgtaaacaccagtacatgacagtaatgggtattataaactttgaaattattccaaatatttacctgatttactataataagaacctggagtgttctctttctctttgtgagtctgacttttgttttcttgttttttttctttcctttttgttttttttttttttggggggggggggttgtttggtttttttcatgctggggattgaaaaccagaaccttgtgaatattaagcaagtttttatcacagagctacagccccaacttcctcttttagcaaactcagtatctgagaactcagggtaaactcacacttagaaatgcagtgttaaaacttgtcatacccaatatgtgagctactaaccttaatggtgtaggcttgactaacctcattttgttccctataatttacaacttgtttttacctctgtaattttatgattcacatgccttaaaaattgtttccattgttctgaaccatccccagggaactaactgaccacaaccccacaaacctgagcatttcccaggcttactcaaaatagctaactgccactttccctctttgtattgtgcttgcatccaaaaagtccatatctccaactcccataagattgttaagtcagaacagctgtaataaaccaatttgcattgcaacttcttggtgtgttctcatttggttccaacatcataacaaaaaacttcaattcaaagtgcctgagttgaatgggcatttgaagtacataaaccatgttaacatctctcttttttgcagagattagcagtgttttctaggcacaatgtgactattatttttgatttatacttcctctgattatttcagattttagcttgcacaaacattaattattttggttattatatctggaccattagtgtcacaaacagtcccaaaagcattgccaaggcagatgtggctattagggggtggaaggctgagaagtgtcaaggcacacacaaaattgagtcaggacaagatagtattaccttagtcacttcagtgatctacacccagtgatttgcttctcagaagacacttggcacagactgctgcagaccacaccttgttagttttcctgctaatctttgatgtcttatccagtccatgccagcacttgcactgccctaattcaacagaacatcatcaggcagagttcttatgaaaaaataaattttaggttgagagcatttttccatgcatcttcagtgttccaagatccaggaccatctttctaggaatgttcacacaggcaagaaaacagacagttaggaccttccctagagcaaatacatttgcatttgtggtggtttgaaagaaaatggcccccaaagggagtggcactattaggagatgtggccttgctggagaaagtgtggcactgtgggagcgggctttgagatttcttgctcaaaattccctcagtgtgacagtcagcttcctagtacctgcaagacatagcactctcagctccagcaccatgtctgcctacacaccaccatgttaaccatcatggtgataatggactgaacctctgaaactgtaaatgaattaccccaattaagagttttctttataagagttgctgtggtcgtggtcatggtgtctcttcacagcaataataaccctatgacagcattccttggttaaaaaagaaaagaaccaaacaatgacttttctaggagttgatagtaaaaccttcagaggctgatgcaggaggattaagttgaaggcccacagctggtcattgaaagacttaaaaattagcaaagaaatacagcccagaaactgaccaagactactactatgacttagtgcctggaatttaccagccaccaggattactcccttacaaggccataagataactgagtaccaagaattcccagatggccaccctccccgaggggctcgtgaaggaaacagattgccccactggccaatgtgtcaataattaagggtccctgtgaaacaaagagatagctacatatagttagcacatcctgaggtctgcaggtcagaaatctatctgattcccaggcctcccctcaagacaaagggcctcctaggaacccatgactcatgggttcaacagacagagagtcgaggcccctccctcagcttatgggtgagggctttaaaaaaggcctgtgcctgggggatggggctgctctctagcctgcatgctgggagagcctgtttgtacaaatatctacctttcattaaaacctcttgctgtttgcatcaagtttctgcctcctcatggtggttggggtggcagcagtctgggaaaagattctggaggcctgagcttccgtggggtcttacagtcatggtgacacacatttggaatccaactttggattccaactttcttggtgctcataaactctctaggcatgtctatgggcattttgtgtcagatttcaaatctccactgaatgatattgggtttgtaaacactcttcatgatatcttttttactctaatattcctaagtaatttaaatgttggcattgttgtgaaggattgtatagcatgataaataaaagacccagagacttctattggggttcaagcttcaaactgaagatcagaaaagaaaagcagccagccactagctcttacctttacctcagctcacactgaaggggcaatcttcaaactgctcctgatttcactgttcctcagattcactcagactgctatgttctcctcaatgtagctagagactaatcctaggactgaatgcctcttttatacctctcaaatcctgggtttaaaggtgtgaactctgattcactctcaggttgcccaggatgatcttggactcagagatccatctgcctttctcctgagtcctgggattaaaggtgtatactaccaccacctgacctctataagtgtcaggctggctttgctttctgaatcgtcaggcaagctttaataaatcataaatatcaccacaggattgtacctggaaagtggtgaaatgtatgtcccccaggaagacacaaggctgtgagcttaatgcattaatgcctaatgttcacacattgtaattcccccaaaatatcaaggttcatctagttaaatctgctaaaataaaacaaatattatataatgtttgaatcttaaagggtcatatttaacttttggagaatgagcatggtttgagacaagagtctcattctgtatctccaggtggcctggaatttaccatgtagcccagacaagaactgaactcttcctgtgtagtcccctgagtcttgggaacacagagtgtgagctacccagaaacccatttcttgaatcttgggctagtcttgtgacttgctttgaccaatacaattaaaacaaagtcatgccaagaacccatatatattcacatccaagtaacttgttatagattaacagagtgtgaccaaacagggtattttttttcccagtcagttcttttactgacaagctgcatattgtggttacaaagaaaggaccaatcactttattacttatcttgaaaagtaaccttatagggaatcttttttttttttttttttnnnnnnnnnnnnnnnnntgtgtagctttggagcctatcctggcactcaggctggcctcaaactcacagagatctgcctgcctctgcctcctgggtgctgggattaaaggcgtgcaccaccacccagcacctgaagtcattttcaaagctttgtttcaactataatgcactctgaaatctgtgaacacatctcccaacattaagattaaaagcatttgcactttctgtgacactgggactcttaatcattaacgtaagtcacagtctatacggtatcccaatagaaactcatgtgttctagctgtgtggcacctccttgtcttattttttatcctttgcagcatctgctttatcatatgcagaagcaacattttatcctacctttacctatgttaattttcctactaaactaacctctatcataatcccttactatatgtattaaaaaccctcaatcatcaaaatcctatttaaactaacactattattgtataaaatcattgcttcagttaaacagtacagcttaggagcatcttcataataatccacagctaaaagtgctcaatagaacaggatatttcccagagaggatcctactgcattaaggacagttgggatctcccaaacccattcacaccatgccagataccagagagaaatggcagcagcaaacatgcacaaacacagtagtagcaagaaacattctgggactgaggctcttgggggaccttgcctatctgagattcacccatcaaggttttgtttactggtgggcagatcccctgaagtccattgctatctgctcttcctctaatatggccactggcacatgacctctatacctcattctcccaagatctttttgttttggttctcctttacctttaccaccttaggatgctccatcaggcctactagaaagtgtgactattgtaaaaagagaccaatgagaaaccaggcaccattcagagttggagaagtcattcagtcttactatgccagcagattgaacttgagcaaacgctatgaggagatgggaactgacccataatcttttacatttttaggctaagtagtgtcatttctgacttttttttctgtcattgatgagctacactttcaccctacatgattgaggcccatgctcagaagtttgtcttcaatgagcacgtttactgatgtagaaacaataaggttagaatggctattgctaatgtctatttctaaagatacggaaggaggtttttagcctgttcagactaatgtatgttttctagagacaagggagaaattttagctgatacaggagtaaacacgaagcagaaaataacacacattgttttatctataagtttagtaaaaatgttaactcattctgatcctcttcattatttccccttttgttttgacactctcccttctcactctccctccctccctcccttcctcccttcctcccttcctctctctctccctcacactctcacactctcctacagaatctttactattaattattgcaggcactttgttagactcaggagcttactatataggccaggctggccttgagctcacagagatcttcctgcatctgcctcccaagcactgggattaaaggcctgtgctaccatatcaggcccttatactttcctaaagtatcaatttctgtgttttttaggttgataaactaacatttgaagtttgatggcctctatatgagaagagggaaccagacaggcaaattaaggaatcaggaccaaacaggaatatcataaaaagcttgagtagagggccaattaacagaagtagccagggtgcctaattcaaaatcttattccaataactccaggaatcaaatgcatagaggctatcaaacttcaatggaagaccggagtttatttgagcactagctcaagttgggcactctgctcagaaaggctgagttctccgttctccaactagtgcttgatgtctctttgttctacttatgtatgcaacaaggtggatgaagaggaagagttctaagtcaccatcagctatgaacaggttaaaggacagactggtagagggatttagaaagctggctcaagagtaagagcactttcagccgagcgtttgtggtgcacgcctttaatcccagcaccctggaggcagaggcaggcagatctctgtgagttcgagaccagcctggtctacaagcgctagttcattccagaacttgaggacgccacagccgtcaccccctcctctcgggccggtcagccgaaacgcgcaccatgggatccatcctgagtagcggcatcgcgggcgtggaggacatcgacattcaggccaactccacctaccgctatccccggaagtcggggtttctgtgtaataatcctggctgtcctggaactcactttgtagacaagattgacctcaaacgcagagatctacccattttgcctcctgagtgctgggattaaaggtgtgcaccaccaccaccaccaccaataggctagaagtggattgattgataatgaactctgaacctttgaaatcttacaatagcacagagagagaaggaaatctgaaacacttcaccctttttttcacaccttaaatcacttccttagacctttacaactttcatttatacaccttaaaccattttcttagacccttacaacttacataaaacttcaaaccatttcttttcatccagtcatttaccatgagacacttggttgatcacggagagaatagtaaaaagttacattggaaaaaaaaaaaaaaaagctagttccaggacagcctccaaaagccacagagaaaccctgtctcgaaaaacaaaaacaaaaacaaaacaaaaaaaaaaagagtaagagcactttttcttgcagaggacccgggtcctttcccagtacccagatggtggttcataaccacccatgacaccagttttggggaatctaacattcatttctgactgttaagggcactaggcatgtgcatagtctaaataggtacatatgggcaaaacactcatatacataagataaagtaaataaatctttaaaaacaacttttaaaaattaaaaggagaaagaaaaggggaaaataacgaggatagagggaaggagggaagaaaggggagatagaaggagggacaaaggcagagagagagagggaaaggcagaggaagggatgaaggaagggcagagatgatgatgcagacctttagttcaccatgtgggagccagaagcaggtgaatctcagagttcaaagctagctgggtttgcatagcaagttccaggtcatccagatctacattgtaagaccctggtctcaaaacatcatcatcatcatcatcatcatcatcatcatcaatcatcatcatcatcaaaataaagaaatgaaggaaagaaagagaaaggaaataaacgaacatctgatgggccagcacctacatgttttgaaatgtccacatggtgactcacagccatttgtaactctagttccaggaagttcaattctttcttttgacctccttggttaccaggtgtacagtggtctaaacaagaatatctttttttttttttttgagggaaggctttaatgtatttaagtttttggtattgtaacagagcccccagaccttagtagacccctggaccttagcacaactgactccatgacataagtgccattcaggctgtaaaactcagtacatagacagcaccacctgccaaaaaatgaaaacaaagacccaatccatcaaagtccatattatgggaaagtttcttaatgtactaactttgctttttgacttctggagtaatgcttctggataactgttcttgttaactgaagtatgtcatcctgagaatgctaaacatcatgctacactgggaacctgaacacctagtgtagttgctggtggagtaataaagactttctattgacttaaacctcatgccagtagttttctctagtgaataccccacaacacatataacctagattgatagggagggaacatagaagagaaaactgtgtgctaaaagtgttgctgactgttgctcatctggtgaagataccagagtatgatgtacttttcttgtatcttttctctagtttaatgttttgttttgtttttttcacaccaggcaaggtaatgttgtaagaaatgttgaataattaatctatcctgtaaaacactgttttttatgcttaccccttctctcttactgctgaaaacttacagattcccagatttgtttacttagttcaatgaccacttctaatgagattttatttcttctataaaacaatagcatgactacttccctttactaaaagaaggaatgtttgtttagccagatgtgaccatcctgaaatgattaaactgctctcactttctccctcttcttcaccctctccctctcctctttaaagccatttttcatactagctgatcaggtgtagacggtgagattgaaccttagacaataaacgaggaacaagttcctcctcattaagaataaaggtaatgataccttggccatgtgtgctgctatttcacttcagtgtcttgcatatattttcatcagtacaatttgccttgttgaaatgccttaatcagggtgggtgatggtctctttctctgcaacacagaatatttctagcaatgtacacctgtaatcccaacaatagggaggtagaggaaggagtattaggagctcaagaccatccttgaccacttggatacttggaggctagaatggaatacaggagactttatcaaaaacaaaacaaaaagtatgtacatgaagattgcatggcttatatcaaataccacacaattttatgtaaaggacatggacatctatggattctgatatctttgggatgtcacagcaacaggaaacacagcttagtgttactggtggtataacctgtgaagatctctcagagactcagaggcctctaccgagttgattgcaatggaattcttgatacaatttcacagaaaagacttccaagacaagtcaaagtgaagccaaatcaatgaatttattgattagcggaaaggatgaacagatgcacttcagagtcaggtgtgggctttgaaaaaggaacaaaccttggtgctgaagtggtttggaacttttggaacaatactgtttaaaggaaacaatctgtaactaaggttgacagggcaccaccccctccctccacaatatattgggttcctcatttcatttctgattcattatttttggtgatatatttggtgatatatgattgtaaggagccttgtaaccaagcaggcaaaggcctggttggaggggcttaggacagaggctacaacagggcaggcaaaggcctggctggaggaagattaaaggaaagggagcgtaggcccactacgcagcccattgtagataagagtgaggatgtgtggagtgtggcaaagtgtaattaacacgatttagcgaactatttaaggaccagctcagaactgggaattttagagtgtaccacgactctatgtcctggagctctcctccgctaacctaagacaaccagtccatcaacctgagtaccgcctgttctgagctcgattccagcagactcgccagcctgaatccagaggagctgaagtccggagcctgcaggctgctgcaggagaggtaccccctgctgtgaacctattgtctgtggttcttaggattgtttgcttatgtttgtgtgttgctttgacataagtgtgaagtaaaactcatatactcaaaaccaacttgctgagtttgtcattcctcccaggtcaaacctggtaacggcttaagacaatgatctaataaagattgcctaaagatcagaatacaaagctagccacatccatagaggccaggcaatggtactgtctgtatgcctttaatcccagcaccagagaggtctataagaccagagagcccagggtcccatgtggtattcagactgcaatcatgctgaagacaggattgccccagccctgatagaggtacaaactctctagtggttagctgctttgcttttctgatcttcagcttgaatctcagtacctgtctctgggtttttattattcgtgcttatattttctcgctgatgttatttttttgtttggttggtttggtttggtttttgagaaagtgtttctctgggcaacagacttagatgtcctagaactggctttgtagaccaggatggccttgaattcacagagatccacctgcctctgtctcctgagtgctgagattaaaggtgtgcaccatggttcttaatgttttgagccaaggattcactatgaaagattaggctggtctcaaacttgtaagaattctattgcctctgcctcccaaatgctgcgattataggtgtgtactgaaaaggcccaacaatatgaatattaattaaaaaatgacttctcttgggaactgggaagatggctcaacagtcaaaagcccaagattctcttctccatgacctgtgttcagttcccagaacctacagatagcttactaccatctgtaacttcaattctaggggatctgacatcttctggcctcctctagagccaacataattgaggttcacagacatacaagtaggggcaaaacatccatacacgtaaagtaaaaataaataaatcttttatgtaggaattaaagtttttgtttgtttgtttgttttgagataaggtctcactatgtagttcaagctatcctggaactcactttgtagaccatgctggcctcctagagcagaactgctacatatctgcagggaaaccaacccccaccagaatagagctatataggaattgcctggcttctgacaaccaggataccttttcctccagagctgtaacactcacaactcaatcctccatgaccatacataaaccctagcccctaaatagggatgttggacccccagattaggataccaaatagtcctggcagtcaccctgaagaaccaatatccagtccagtagatgcaatcagcaagaggaattttattgagcattttcgcaaacgggctccccagtcagacagacaggaagccccaagcaatgcaagcaggctccttttaaaggcaaaaaccacaaagcctaggggtatgagtcgttctctgattggaggactcaggttcgtgctcagggcatccattggggactttccgtgcaggggaacatgtggcggagctattgttctttttctgtaagctggctgtaaaaactttcccaacttcctgccctatctggctgtaacatctgcctcaacttcctgccctcaatgggggagttaggccccgaggatctttcaggaagagcagacagtttccttaatttctggtccatctctgtaagaccccccagaaccttaggcctccgggatctcagcccaggaccggggtcaccccaatcaccaggcagagtcgaaagcttgatgcaaactgcacaaggctttattatagttgtttaacaagctaaccccatgttagctcaggcctttcatccacctgatggtagatggctagaaagacagctcgaagtgtctgcatagagatcttatagggcagcataaggagagtgtctaggggtacgcacaggctcaggattggtgtgcctccaggcttggagggtttgccctgtgttgattggtcaactggttgttatgtcccataggccttcacagggtggttgctatgctctgcgcgtcattgctgtgcacttgtccgtaaagcacacccagagccgtaaagcatagcaccactagctaacttctgattggttccttgccacgaggcaggcatctgacttcctagtgactaagacaaggtcagacaagcacgcgttcggctgttatggctgccaaaatggggagtggtttcctcatgtctatagagagaataaatttcttggattttgctatcttggtgtaaatacctaatataagagtttcagtttccacctaagataagccaccacactggttcctgatttctttctttccttttcttctttccttcctttcttctattcaaggaatggattgaaaatgagacacagacattgttgtggacctggagacccaccagaaagatcatctggactctactgagttttaatcagctaaattttatttaagctgcagctgacagagcccttggttagactcaggactgcagccctgtctgggagagttttttcttgtttttttgttttgttttgttctttttaggcaaaaactacaattatttaattacttcccttctgtagacataagataacaacacacaaacagttactaagcaagtttacagaagtcataataagcagttagctaatcattttacaactacacatcctgggaaaggtcaaaagggtcagcatttcctggggttccaggagcagaattaacttgctagaattgacttcttagactcatgaccaggctttttctttgtttttgtttgtttggaattggcattacagacagttgtgagctgccatgtgggcacagggaattgaacccaggtactctggaaaagcagtcagtgctcttaaccactgagctatttctccagccccctggacaagttgtctttaagactaagtggcagaactctgtgagttcaaggtcagcctggtccacagagcaagttccaggacagccagtgtaagcccctgaaggcacacaagtgaccagacccctcccctgaggacctccaactgccaggttccaccaaaggacattccagttgccctaccagctggaccctacccccaccctataccatacaaagcccaagctctccccccctcccccccccccaagaacccctatataacccctgtcttctgttcagttttctgctgtttcttgcctgaatagaggcagccactatcctgggtttttttctttcccaataattctcttgtgtgaggtttgttgtgtgattcgactttgtggcattggctcccaactaccaggatgctttcccatctacatagaaaaactcgaaaaccccaaagcataccaaaagaaaacaaaacaggattggccatttgtaggtataagtaggagcatcaagaaaccaccaaacacaatcaaactccatggaaaaacaagtagcagctttaataaataataataataataaaataataataataataatactgccaagcctcctctgaccatagagaacaatacaccactgggaaagtttgttgggttatatagggacaaatagaagagggacacacatctcagatgctgaaatagccaagtagttaccttggggacaatggagatgcacctgttgtgggcagagagttccagtggccactgtttgggtccggagtcattaatataaaacattaccataggatcactctgccattcccctgtcttggagtcctaacagtggtaaggtcccatgggtccttaggagttagacttgaggcaggtccaatctgtggcatgtatcccaggataaatattaatgtggctcaacatatttacagtaatgttccaacatctaaaggttacacaccagctggtgagatggctcagtgggtaatagtactttgcattgtgtctaacaatgagtttgatccctgaaacacaacggtgttaggagagacccaagtcccacaagttgtcctttgaagtccacacacacacacaccatgtcacaagagtacacacacacaataactgtaaaaaacaaaaaaagttaaaaaataagattggacatgcctgctagatgtttgtatcagacttcacaagtcatggactgtgtcaaactctgtcaatttctgtttgaggggatttcagtgtctttgtctctacagataggctaaaattgatctttttgtctctacgggtagtatgaagttggtatttttcattgtgggaggcagaaacatctaaaaataacaagcagaatgaggaggatattttttcctattttgaattaaattttttcttttttttttctttttctttttttctaacatgtggtgttttacctgaatgcaatctgtgcctagtgcccaatctgtgcctagtgcccaagaggtcagaaaagggtatcaaattccctggaactggaattaaagactgttgtcactatgtgggttctgagaaccaaatttgggacctctggaagagcagtcactgctcttaaccactgagccatcattccaacatttttttcagatttttgagacagggtctctcactgtaaccccttcaagctgactagtctgttattgaggatataattgaaactccaacaacttatcaagtgacagtcgagccagctcagaatgaagagcaccattatcacttgccaactgtgacagacctgtgaatgtggcacttaccataacttcagagcctaccaaggagatggaatcttttctgacccagcaggagtccccaatgcatcatccagagtacactagagagggagaacctcttcttagtgagcaggaacagccagctcggccttctgagctgccaggtcaaacttcagaacatgctctggtacatatcaagtgcatcctccagcatcacaaatgtcacagttaaccctccagagctgattaatgaggttgaaacgtcaatccaactggggtttgaacctcctaagcatctcagctgagaagagcttcccttctgtttgtatgagtgtatacacttaaaatggacatgctcattctgtataattacaattattatatattttacatgtctacgtatattattacattatgaataagttgcattatttaagaaaagtaatttgtttatactctataacctattagaacaataaagtataataaaattcttttcttttttattaagagttaaaagttaagccaggtggcaatggtgcacgactttgatcccagcactcaggaggcagaggcaggtggatctctgtgagttccaggccagcctggtttacaaagtaagttcacaggctatatggtaagactctgtttaaactcattcagtcaaacgaagagagtttaaacatttttatcagcacagattaattataaaccatatagttttgctaatattttcataaatgaatataatgaattttgatcattttcacaaccccaaccctcattatcctttcttgtctcctactccctctgatgacctttgttagatcatgtgactttaagatcagatccaccacccagttgggtctgtcccttaaaaccaggaaattagccaggcattggtggcacacgcctttaatcccagcactcgggaggcagaggcaggcagatctctgtgagttcgagaccagcctggtctccagagtgagtgccaggataggttccaaaactacacagagaaaccctgtctcgataaaccaaaaccaaccaaccaaccaaacaaacaaacaaaaaagcagcgactcttctacagcagatccattaaaagaggatcctgcttgtgggaagccaggccccttcacgagactgtctctggcactatggcattctaagtttatgggttggtatggagtgttctcatctgaaagctaaacaatttcaatttagcgagattataaggaatatgtatcattcctgaaatcacataagagtgcatgtctcagctcttgctttaggagtactcagtggagatggctactgctatccgtaaaacgtgcgtttgaagtcggtggcgtccatgtctaaccagtgtcttgtatcacggaacccggcatcccactagcaaaagcaatgagttgccagcagcctttgcctgaacagtggtttagggagccaggctggcaggaggagcaggcaggacggggcaaccgtggacagcaagaactacaagtcccaggggacgtttcgcgcagctccgcccctgctccgaatgtggccaacccccaggccctactccgtgtgatgtcatttgggcttccgcgtcctgcgcgaccggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatcccagcctcctgggaaccgaaacaagagggtttcctcgagttcgaggctagcggggttatgttgtgagacacagcccctctaaagcaaataaataaaaatttgaaaagctttgccgggcggttgtggctcacacctttaatcccagcattagagaggcagaggcaggcagatctttatgagttcgaggccagcctggtctgcagagcgaattctaggacagccaggtctgttacacagagaaaccctgtctagaaaacaaaacaaaaataaaaaatgaaagctacaaagacagactacttggttctattgatggcatctaacattccatgagcaaatgttatttcttgcctagcttccagtgttttcttctgaatttctttgttattttttttcctcatgagacagtcccatgtagtccatgctggccttgaacacacttccgctccctgaatgctgagattaaaggcatacactactatacacggtttacctaggcctcctgggtactaaataagcataataacaactcagctacatccccaacccttttgttttgaggcaagatctcatgtaggccaggatggtgtcagactcacataccaggctgactttgaactcttgagccttacttctgagtaagattacaggcttcagttattaccaccagcttgtcgcttttgcttttggcttttcgagcacaggatctcatgtagcccaggctggcgttggactcactacgaggcagaggatgaccctgaacttcagatccgtcctgcctgttcctcagagtgttgagtttaccaatatacattgacacacttgactctgtgggacagaacttaaaacactatttagtggaaaggaaataaagtaacagttcagaaaaattattggaaatttggaactaaaacaaaaggatgagtacatgatttgtattgtcataactggattttgttccttatgtaaaggtccattttgtcattaggcctagagtttgcaaccctttgagtgaggaactacagcctggaactaacagttggttgagcaagttgtttctgttttgtaacaaagtaaggatctcatgtcagagtagcattcagctatgccaaaaacaccaaagtccagcagatgggaatgtctatttaagaaacagggcttgatttacatcctgccttctgttccttacctcctccctgaccagcaccttgattagcacaacctaagagaaccctttagatccggcatctagtaatggtctttgaatagaggcaccaaggaaagagaagaatcaagtcaccatgccttctgcttatagcctgtataaagggcatggaagaaggaagctgggtctctgcctgcttgcacttgctcttgctagcaagtctattccttcactggcattagagccctacttcttcgggattccagtgtatactgaagaccagctgagacatccaccctcatggactgaacaaccactgattcttggattctgttgatagacaaccatcttgttggtctagctgaaccataccatgtagccattctaataaattccatgtatatattctttaagttctgttcctttagagaaccctaactgtaatgggtaggttttgtttctcaacttgacacaagctaaagtcatcagaggaaggagcttcagatgaggaaatacctcctataaggcattttctcatttagtgatcaatgagggaggacccagctcatggtgggtggtgccatccctgggctgatgctttgtgttctaaaagaaggtgggttgagcaaaccatggaaagcaagccagtaagcagtacctctccataccctctccatcagctcctacctcaagggtcttgccctgtttgagttcctgtcctgactttagtgatgaacaacaatgctaaagtgtgatccaaataaaccctttcctccccaacttgctttctagtcatattttgccacagcaatagaaatcctatgacactgactaatacagattttggtgcccgggagtggggtatgactggacaggccttgtcatgctgtttatttgagaaatatggaagactttgggactttggaaacattaagtggggcttactgggcttactactagtaggaacattgaagacagtgcagttgagtgcagtttgaactctggggtgcccagaaagaagcttcagaggagaaggatattagcaagtggtctaaagaccattcttaggatattttggcaaaaaatgtggcccttgtccaaaacaatctgcctgaggctaaattgaagagtttttggcagaagagatttcaagatagcctagcagtattgactatgttatggggttattagtaatcattttatatgcacatctataatgaaagatgaccaagctgaacacagtgttcaaggagacaaaaaaaaaaaaaagttgaaagaaaagcctggtgctaaatagaataaagagtgctgacctcaggggaagaccccacccagctaagcatccaacttatgaaaaggaattaaaggaaagctaagcagtgaaggaaaacatcaacaacagaaagcccatgcaaatgtcattgaagtagccatgttctaaccccagcaagaagaagaatttggccgcttcagccacttgcttccagctttagagtatataagaaatatatatatttcttatatatataaggatataagaaagagattatggaatctccctctgtggctaaggcaagccactaatgccaggggtgtccctctatggaggcccagaaaggacattgtgtgaaactgtgaagataaagcctggattgtcttggagaccccaatatattatagcacaaataacaaatttgtgggatacttgccaagaaaacctgaataccaagtgtggaaccaacacaagaaactgaagtatgttgcagtcaataaagctgaatttggggtttgccctgctagttttgatcatgatttgttccactatttcctcactatgctctctttcctcccttttggaatggtaatgtatattctgtgttgatggggaatgtactgtgtacatttatcttattgattgttaaataaaatactatttggccaatgagacagcaagtagacgggactaggagtcaaagaggattctgggaaatgtagtagagaagtgtgatccaggcaggaagtgacatagaaaggagtcctatatttaagcgaaggagaaacaggaagggcctctcttttcccctccactcctgctccagtggcacaatgtgatccaccagctaggagggacgccaatatggcgtctgataagtcttataaaatatatagatttataataattaagactgagctagcagatgaggaatcctagtcattggccaagcatcattgtacctaatacaagtttctgtgtattcatttgggccctaactcgggcgggcagcttgggtaaagctcacacatggcgctggggctcaggcagcttttggcggaaagatttatcaaaacactgtgtcattgttggaagtttctgatttgccttttgattttacaggggagttagagttcagagattgccatgagtctcagaagagactttgaactttgaacttttaaacagttttgagagtgggataaactatggggacttgtggagttatactgaatgcattttttacattatgatatagctacaagcctttaggggttgggagtggagtatggtggtttgaataagaatgcccccccataggctcataaatttgagtgtttggtcagagaaatgaaactctttgataggattagaaggattagaagttgtggtcttgttggaggaagtgtgtcactgaagggtggactttgaggtttcaaaagcccaagccagggccagtgacactctctctcattctacctatgggtcaggatgtagctcccagctagtactccagcaactgcctgcatgccatcatgataaatggattaaacatctaaaactgtaagcaagcccctattaaatgctttcttttagaagagttgccttggctgggcgttggtgcacgcctttaatcccacagagtcaggcggatctctgtgagttcgaggcctgcctggtctccagagagagtgccaggaaaggctccaaagctacacagagaaaccctgtcttgaaaaaaaacaaaaagaggaggaggaggaggtgctttggttatggtgtctcttcacagcaatagaatagtgactaagacagtgccaaaaatacacattagaaaaaaaggcagtctttttggcagctgattctgggaaggcatttagaaaaataaaactatatccctatcttcccatataaaaatcaacttagcgtggatcaaaggccttaatgccttaatgtaagacccaaaaccctgaaactgctagaggaaagcataggcatatgaatggactatctgaaaatgagtgcaataactcagagaaatagatcgaggaattggcaggtaggattgaatgagattaaaaaaagaaaagcaaaaaagtacctttgcaaagcaaaggaaatgggaagaaatattttgaggggaaaagatctttgccagctatacatctaatatctagattaatatctagaactcaaaaaatgaaaatatcaagggctggagagatggctcaatggataaagatgcatgtctccaagtcaattcaattcctgggagccacacaatgaaacaagagaagtgactctagtagatgggcctcggatttccacctgtgtacaatgactcatatatatattcacgacgacatatacacataaataaatgtgtgttaaaattttttgagaatattttatgtattagctagacaatagtgatgcaggcctttaatcacagcactcaggaggcagaggcaggcagatctctgagttcaaggccagcctggtctacagagtaagttccaggacagacttcaaagctacacagagaaacccttgtctcggaaaaaccagttatcaaggaggtatattgagaagtaaatatattgggatgctgttctaggaaattatcatacctcctttcacaatatcccttttatatgtccatgtggggttgtgtatacaagcatggacaaagaaagactgtgccctaggttaacataagacactaatggaggttagataacggcagaaaggggaggatggaaatattcaaaagaggaaagaaaaaaataaagattgcactaaaaaaatgataacaagtatacatcatcatttgtgcattaaaattcggtatatatagtggtatttgtagacagaatttgtaactacttggcacaggtatgagtttatcagatagttagaatttgaagctgtaagacatgttggtcacattgtaataaagagtctttattctttcagagaaatagtcaaagtggaaggctttatttagcacatttttggcaaagagcaatgcgtgaagagatagcgggacagaataaactctagagctgacagtgagagctataaggaggggtgtaaagtttgtatggcctttggcaactacacggcccaggctctaggattaaggttatttctggatatggttcagagaaaggcatcctgctcaaagggatttcttgctagtgtaggagaggataggtcagagagcctatttatcctgaaataatcaatgtgccataatgaaatcttggttaagttgtcctcaactgcttcagggtcttagtggttacctcatcctataattgcatatgcaggttactgatttgtactctccatagaatctttgtgattatacttttttctctagtcatttgttgcccatatacagtttttgaaaattgttttatgtgtatggacagcgtgctctgaatgtatggatgtcagtacaccacatacatagctggtgtctatggctgccagaagagggcataacactgtagtgatacattgtttattatttaataaagcttgcctggggatcagaatgcaaagctagccatactagttagctttagaggccaggcagtggtggtacccatctttaatcccaggactcaggagacaaaggcagatgaattttgtgagtccaagaccaccctgggctacacaagagtgaaccagtctaaaagagaaacagagctcatgcctttaattccagaactagagtgctatataaggaagaaacaaaaagtctcatgtgagattcagttcccagtcatatggaggacaggattcccatttcagacttggtaggcgtaagagctactggctggctgctttgcttttctgatcttcactgggtttttattattcatactacataagatcccctggaactagaattacagtaagctgtcatatgcattctgggaatcaaacccctgtcctctggaaaagcagccagtgcttttaatggatgaacaatctttccagtcctggttttggttttctgagatggagtctgatgtagctcaggttagtctccaactcactgatgataactcctgatctcctaccacttcctggtactagtgttacagtcatacactaccatgctctccttaaaatgtattttagtaaagtcaagcctgttatcctagaattctaattgtaagccaggaggactaggagttccaggtcatcctgtgctacagaacagtgggttagaggcaagcctcggctacatgagactctgtttcaaagcaaaattttaaaatacatattgacaaagggtatacagaggtaaagtggtaaagaaaaatgtcatgtcatatataactttacatacacagtgattatgaatcttgtcaagctaaatttgtaacttttatgaaaggactaactgctgacaagcaaattgttaagtgtaagtaaccagtgcagacacagtgtaatctactatattgtgtttgtatttcagatgtcttcggtgcctaataatcaatatttccagatatatctcagatattaaatatttgcctcccaacatcaaagatagactgattaaaataatgagcacccggggccggataacagattccaatataaatgaggtaagaatgtatacctatacaattatgcttcgttaaaagagagtatgtagtaagattgttaattgtcttaaaataggactctgacttgagaagccagcacccaccttcggacgtgtgctgtcttctgctatcctctcctcccttcccctcccccctctccctacacttcagtatatatcaaaacctttttattgtggttgctgcttttgagacagggtttcactgccctggatggccttgaactcatagcgatctgcctgcttagaaactgagccattatttattggcctcaaggaaatactgaacagtagatccccaaaacaatggacatgtactaactactccaaacaatgaaagacagttggacatggtagattatgcgtgtaattctagtactcaggagtcagaagcaggagatttgccatgagtttccagtcagcctgggctacatagtgagttctaggccagtatgtctctgaaaaaaaagaaaaaaaagaagaagaagaagatgaagaagaggaggaggaggaggaggaaaaaagaagggagtggagagatgtctcagcagctaaaattacttgctacttttctacaggtccagagttaagtaccctcatccacatcagaagccttaaaactgcctgtaactctggttcctagggatccaatgccaaccaagcctccttagtcacccacacacacattaaaaaaaaaaaaaaattggagctagagagatggctcagaggttaagaccagtgcttgctcttgcagaggtcctaaattcaattcccagcaaccacatggtagcttacaaccatccataatgagacctgttgccctcttctggcatgcagtcagaacactgtataaaaaataaaatctaaaataaaaaaataaatctaaaaaaaaatcttaaaaagacatggtgaggccaagcatgatggctttcacctttaatcctagcacgcaggatgcagaggcaggcatatctctgtgatttttgaggcctacctgctctagataatgagttccagaataaccagggatatatagagaccctgcctcaaaactacaataaaaaggtatggtggtctttatctataattccagcatttgagaggctgaggcaagaggatcaggagctcaaggccagtcttatctaaatagtgactttgaggataaaagttacatgagagtgtttcaggaaatcaaaaaagaggctggggttcaatggggaaaacacttgccaggcaagcctaatgacctgaattcagtccccaaaacctagttgaagaagagaataactctccaaaattgacctctgacctctatgcatgtactatgacatacaccacacacacacacacacacatacacacaaataatagtaataattatttttaaacaaaaaatatttttaaacaaaagactgaaaacatgttaaaagaagtaatactaggcccaggtatagtggtacaggcctttaatcccagcattaagaaggcagaggcagtgagttcgagatgagcaccaggccagccagggctagtaccctacaactaaataccttgcctgtaatatctagtatctaagagacaaatgctggaacacaaaaatgtgttcagtggctggagaatgaagaagtgggagctttgctcacaaatgaacatctccctgcagggacaatgcgagggtagagggactgataaatgtactttctgggaatcgacaaagatcttccaagaactcggtgccacctcgttctattccttttattatctgggacttctcttcatggtggctggtaggcatctttagccctaagtgggtctgagaaaagactagacaactctaggtcaagttaaccctgcatttctcagatgttcatcatgtctacatatagaactatgtaagatttaacccaaagatgaaggcaataaagagacagacataatctagagacagatgtcaagtgttgctttctatttagctcacccatcagacatttgttagcagcaatacttgtcaagtccctgcactgtaatctcagttaatgttaacacaacccccaggcaggggtgttatcttcctcacagctagtggtgttgtctgcctaatattgctcagctatgtgacctgcaaaattgggatttttcacttaactaagagctggcaatgctagaagagtcgtttaggtttttcagtgacagtaaaggagagatatgtatcctaaagggattggttatccctgtacctaccatcaggtcatttgactgagaatgtttgaaaggatcttgcctttttccttggaaacagtacctgctgatcagaagcacataggtccagttgagtgagtcagaaatgccagtaggagataaccaatactgtggtctccagggtcctttctctgcaccagcgacttcagtgttgaagactttaagcactgaatgttgcagttccagctagaagctaacttgtttttgttgtttgtttgtttgtttgtttttcctgcttcatcttctctgcatggattaaatcctacattcttggctatatttctcatcaaccacctgttaccaccaccagatgtggaatacatgcgcttacagaaaacttaacttggggcctagagagatggcttagagttgcaaaagtcttttttcttttattaatttttttcaaaatcatgtatttgttacaggtgttacatcccgaagtccaaagactagatctgaggagctgtgatatctcagacttggctctccagcacctgtgtaaatgcagaaaactgaaggcactaaatctaaaatcctccagagaacatagaaatagcataacatcagaaggtatgtttatgatcactgagtccatgggcaggcctatacttggcacctgatacaatttttgagcaaagaagaaaaaatatcttagaggagaatataaaggtaccaacaaagtggggagagggagaagttagaggagaatatgagcaaggtacaaaggcatatatgtatgaaaatgttaaaatgaaacattattttgtatgttaattaaattttttaaaaagagagaaagaggatatgagctaggcatataactgtaattctagtactaagagaggcagagaaaagatcattgcaaatttgaggctttacatagcaagtttcaagctagcctgtgcctacatagcaagagcatataaagagtatacacacacacacacatatatacatatacatatcagtaaaactaatcagactaaaaaaataaatcagagtaagaagaaaaataattcaaattagaattcttgataaccatttaagaaacatgttaagtacctgccttatattttaaacatatttgaaataatactacagtattttaaacattttgcctgttatagtataagatatggccagttgatatttggttaaggttaaggtctttgttgttagccaggtgtgataacaaaagcctgtgatctctatatttgggaggtagcagcaggaggatcaagagtttaaggacagccaggtggtggtggcgaacgcctttgatcccagcacttgagaggcagaggcaggcggatctctgtgagtttgagaccagcctggtctacaagagctagttccaggacagcctccaaagccacagagaaaccctgtctcaaaaaaccaaaaaaaaaaaaaaaaaaaggaaaaaagaaaaagagtttaaggacagcctgagctacgtagccagtttgaggtcagcctggaatactatgaaactgttacaaaaagaaagcgaaaactattgttttggttttttgggttaggtcttagtatattgctgttggctggcttggtattcactttgtagaccagtttatcgtggaactcttagtaatcctcttgcctcaacctctggtgtggtcaaggcactttgcttgttatttatttgtttattgtttgttgagataggatctcactacatccctggctggcctcaaactcatagagatcctcttgcaatctgcctcctgggtgctggaaataaaggcttttaccactacttttttgatgcagtattagaaacaatcatcagattaagatgggtggggtggctcttatttgtaaacccaacacttgaagggtgaaggcagatagatcaagagatcaggggcattctcagccagctatatattgaattttagacttggtgatctacaagatactctatctcaaaaggccaagataaatcagataaacgaggcaatctttataaaactgtctaaaactaaaaccagaaaatttaaggaaggttgtggctaagaggatgacttagaagnnnnnnnnnncagttaagagcacttgctgctcttgtagaggaaccaagttgacccgaatggctgcttacagcacccacattgctgtaacatcagttccatagaatccaataccttcttctcaactctttgggcaccacatacacatgccacacagatatacattcaggaacaacatctatacatataaaataaaaatttaaaaatgactatgattgggaacagaatctaacacagtatatttatatctaaacggtatatttattatgaagggatactcacacaagaagccgataaccagattggcactccgagcagcccagtctcagatgcactccgagacctggcttgaaccccaaaagagggcaagagcctcctctttccttagttcttttatcccatcccttctgtgtacctgtgaccacctgtgattgggcatggtgggattctccctacatgactatgcagtacatgttttatatccagactattttctcagagtaattacatgaaatagtggatttttatatttggttaagttttttggggttttcattttttttctagtatagatcatttttcagttcaggatttgaactttattctttttcagtacaataaagaagtacttagctggatataggtagcatacacctgtaatcccaacactcagaagtctgaggcagaaggacctgaagtttcaggctgcttgggctctgttatgagactgtctcaaagaaaaggaaggaaggcagggaggaaggaagaaaggaattacttgcataagtaggtttctggataatcgtttgactagttgactgtattccccaatcattttggttatccacttgggatactcataatactttaaacaaatgtgtttttaaatggttacaagaaaaataactcactaaaaaaagagccctggaaaaaagtacagccattctgatagtaaataagtatatttctctatacaaagcaattatcttactctccatataccagctgggtggtttttgcatttttaatttatttcctggctgtgtatgtccctgtagaggtcagaggacagcttgggggagttggttctttgttcccaccatgtggattccagggattttgcagcaagaacctttgcttactgagccatcttgccagccccagttgtatttcttactatttaattaaggtctgtcattatctacttggagttagaatcacatgccacagctaaatctgcattgcaagactgtctccagttcatatgccagtccccaagacctgacctccagtaggtacttctgactaatcagctatacagaatttctgcaacttattccttgtgacagggcaaaggttcctccatgttgtcccagctggaaccatctttggtctaactgactccaccctttcctaaacctgcagtgaaaagtcccatgggaaagtaaccaaccctgttctagaaaaatcaaaatcaaaatccccagctaactgcatgatttttgcttctgttgaactgcttgcttgctttacttccccctgcaactgccaattagagtttggtttttctgtgttgtttttattttttattttattttattttattttttcctttaaaagctccctgtaaaatgcattcgaggctgctctgctctgcaggactgtttctctccagctaaataaagactcttaaattcacactttggtggtgctgagtggtctctgggtcacaaccctgcaacactcctcaggatttaataacttgtcattgtggctcacaaaactcaggaatacacttgtgctttgttataatccatgtgagaaagttatagaccatcactaatataagaccaaataagagtcctttatttaagccagagcaggctcttgtcacaaagaattcccagccagaagttcagagatgcagcatttataaagataaaaaacacaacagtatcattgttaggtgtaggttagggaaccttgtaacattcgttttgacagaacacagtagttgttttggttatccatttagtagtcattttggttaaacatctgggctatggttagggtcgtggaaatgtactgccaagatagatatagtcattcaaggggtgggttttcagttgaaagaatacctcaacagacacaaaatggggtcaaggtaaggtcaggacaggatggtgttaccttagtcacttgagtggatgtttactagttgattgcaaatggtatttataaaagacacagatgaatagccacacaaagagaacattggggagggtctagaaggatccccaggacaggagcttttgccccaacagatatggaattttaagtcaatagcccagctctggcagccctagaaacctagactgtgtcacccataccaaattaccagtgaaggaaatgagtaatgatgaaaaccagagaaaggagatttaatcagtgtacattggaagagcagataaagaggtccagggatcccaagttcatctttaggggttctgacacaagctttaggcttaagtagagaaagatttagggcaggatagcaagacagatgcctaattaagtattagtcctggtcaagataaggttccacctatcactgaccaattctgctctggtaccacaaggtattggaatggttaactctgctataacctaagggaaccaatctgtttcctacatatggtacttttactacagagtgaagcctcaccttcatgagtaattctcctattctcaaatagtttgccctctgagatttggctctttaaatcaaggatggctgtaggtttaagacagttatttatcactgtactttaagtcagtgttacaagtaggtcagagccaaatgtttctagattcttggcgtcttattcaaagaactaaaagctggggggggcctcacagatttgcaaaggaggtatgataattttattcagaatgaagtcaaagtacggattatagaaagatatactctcaagattgactatggatcactcaggaatatttaaggaacccaagctacagctttggttttctttttttagagttgtaagggacagtttagaaaaggtcacaccttgcattnnnnnnnnnnttaactgattagaacttcagtgagtgtgcaaagttggaatgttgtatgtccagagtcaaattacagttacttttagctctcttaatagacatttgttgccttcctctgtgtgtcatctaaagataaatcctttggaatataaaaacaaactccttatttccaccaatccaaaaactgagcatgccaacagatagcatctgaggtataatttccttttccccccctataacccacctaaataatgtgcccatcaatgcattttaaaagtgccctaattcagccgggcattggtggtgcacgcctttaatcccagcactcgggaggcagaggcaggcagatctctgtgagttcgaggccagcctggtctccagagcgagtgccaggataggctccaaagctacacagagaaaccctgtctcgaaaaaccaaaaacaagggccctaattcaggattattttagttttgttacgataaaaaataccatgaaactgctaacttgggatgtggaattgggaataacctgactagtgttcagggccatggtcattcatatcaggctctagaataaactatctctaatccctttcaggtaagaatagtgtttttgcatcagttaaatctaaagaagggctgacgactaaagggcatagtttaggtggttttctattttgattgctagattagatcatatattaatttttcctattgtgcatgtcccttcccataattccccttccctgcccaattatgcataggcacaaaatggtgaataggggattctccctgaaagtttactaacagacacaattttgccttatggtgatatagcccaaactagtgcatcctgaattaactcttctattctttgtacctggatatactagaaatacttttgttcctggggtcttggagagggtctgtactatttttcagaagtagcctgatggaggtgggaggcttaaagagttctgagattgctagacatatttgtgcatagaatgcacagataaaggagctgggctgccacgtgcattattataagaggaaggagtgtttacaatcaaaaccaaagagagttcctggctgaactatatctcctatgttgcctgcctcaaaagtaaaagttacagacataaaacaagggaaagatgtcaggcttatatcctacttttagtcaccttgtcagtctgagtgaataggcagtccttttttaacaaaagcagttttaacaaaagcctatttcaatatcactaaaaaattagtgtatcttcatggggggtagggtatgtcctttggtatgctgtggatgtttcttttattggttgatgaataaagctgttttggccaatggacaggcaggatgtagccaggcaggaaatataggcagggttaccagactacaagtattctgggaagaggaacacagagtgagtctcgaggaagacaccatgtagcttctgagacagagcaacaggcctggctatcaccggtagtaagccaaaaccatgtggagatacacagattaatagaaatgggttaataattgagagagagctagccattaagaagtctgagccattggccaaacagttaatatcaatataagtccatgtgagtttatttgggactaaacagctgcaggaccaggtgggacagaaacttcagtttacaataggtatctaacaggacttttccttttgatttgccctctgcttcttttcccttttgcctatccattcctcttagccttttgttgaaaatatgttaattgccaaatctttctgaagagccatggaacccagaatatctagcctttatagtgcccttccttagtttttaacatgcagaatatgtctaagacaggaagcaagccatggtgactcacatatgtaattccagcactctagaagctgagacagggtgattgttgtgagttcaaggccagcctggactacccagtgactccctgcctgaaaagaaagaagaggggggggtggatgaatgtataaataaaagaaagagctacagaaggtctatgtccattgtgatgttctgaccagagaaaaagagaggaacccaggatgatgcatgatggcaaactcctcatccctcccctagcccttgcctaccaagaaaagcccgtaaattatgctttcttgagaatcctacactctgtgtagtagaacttcctcctgatttcttacttggtctctgagttctttgccagtgacaggaacttggaaatacctggtagaaaacttaatttgggctttttttgggggggtggttcgagacagggtttctctgtgtagttttggagcctatcctggcactcgctcttgagaccaggctggccttgaattcagagatctgcctgcctctgcctctgcctcccaagtgctgggattaaaggagtgcaccaccaacgcccagcttaatctgggctttttacctctaagaattcccccactagccctcactaccaacaaaactgctacctccataaatctactttccttgcctctaccccttgtcctggatatactttgcctgttgtgggatggactacttcgaaaatgactaacatacagttggagattgctaaaaatgaaaatctgcatgcctttaatcccagcgctcgggaggcaaaggcagacagatctctgagtttaaggccgccctggtgaacagagctagttccaggaaagctagagctgttacacagagaaaccctgtctcaaaaaaaggaaatctgtcttagtcacatttcttacatatacgcgcatgctcacgcacatacacacacacacacatacacacactacagctcagtgatagagcatttgccaattttataatgatgcaagataatgacctcacttgaaggaggtaagaaattatttattctgaatatgggtaacctaggatactggttccaatttctcagaaaaaaactaatgactttaaaatacaatagtactagaaaacattgcatccagcgactacatttggtgggcataaatcatatcactagtttgaggtaaagcaaggaaactctgaccattggacttagatagcatcttactgcattcctagtgtggtaattactatagtcaagtctggagtctattctttgtcaagttaggtatgtctaacatgcatccgcagaggttaccttgtccaactgatgcttgaagaaattctattctgataattttgatggcattctaaattctgcaatatacatttatgaccataaagttcactgattgtaattgtgttttcccctaggaataaaagctgtagcttcatcctgttccgacctacatgaaatttctttgaaaggatgctgcaatgtcactgatgaaggagtccttgctcttgcactcaattgccagctgctaaagatcattgacctgggtggctgcttaagtattactgataagtccttacaggcattaggaaaaaactgcccgtttttgcagtgtgttgatttttcaactactcaggtaaatgagtcataaacttgatgcaaattatgtgctgcctcaattgtcatccatgactaatcagaatatcacagttggttcttttgttattattgaaattgttgaccatttcttggtataggtggtatgagaatgatttttctggaatgcctcgtgtagcttgccttcagaaatagaacatttgcccaaccttgtaaccagcttcatcatatactttgagatcatttaaagctatacactgtgtattcagcttgtttaactataacttacctttaagaaaaacaacatgatcttcctatactttgtattccccatgtaaatcaaactctaaaagctaaggtgaacacatagctttgatctcaacctacattccttatttcttactcataactactctacgccatgacttggaataaggtatacatcccccctgtaatccttccatgtcactaactcaaaacaatgtgtgaatgtgtataaagtatgataacatgttttgtggtttttcttgctgttctaggactatggggtcagagaaattacttcttcccatgtgaaactcctgtaaaagatcaaacaaaactcactcctatatcatggtcgatgtgcttttcagtaaacagaaagtgtggtcctctgttatgaaacatcaagctcacttggttaaacaactccaggagtcaatttctttcatgctacactgccacagggtggttaataattgtactagaatttacatatttctattcactattttaagtaacaaagatggaatatatgactacaatgcacgtttgctgaatgggaggcaatcattcttcatggttaatgcactttagaagttctcttgtctccatcacaagtatttattttctcttttgctcaggtgtctgacagtggtgtggttgcacttgttagtggaccatgtgccaaacaattagaggtaatttttaaatgtctatgaaaatattaaactttattttatcctcaagaaaaaaatcatgattattgggaaggcagggtactttgtacatttggttctctccttccacctttacattagttctgaagaattcagttcttcaggttcaagtggcaggcctctgtctgttgagacatcttttccctctggcccttttatcttttagaggttttttatttgtttgtttgaatttttgtttttgctttatattttgagcccagactggcctagaatttgcagcagtctcaatctccccatagttagaatcacagtgattgtgattccatacccagattttcatactattttttttcctttttaaaaaaatatttgtgttctggggctggagagatggctcagtggctaggagcattggttgctcttccagagaacccaggttcaattcccagcacctacatggcagctcacatcgtctgtaattcaagttccagtggatcaaactttgcacagacatacagcgggccaaacaccaaatgtacattttttttaatgtgtttgttgtggctcatgtgttttaatcccagcactgggaggcagaggcaggcagatctctgtgagttcagggccggcccggtctatacaataaattctaggccagccagagttacctgatgagatcctgtaaaacaacaaacaaacttatttttatttaatgcaattgggtgttttgcctgcatatgtatctgcactacatgcatgactgatgcgtgaggaagccagaagaggatatcagatcacttggaactagagttaaagagagttataagcagttattttagtttatatttatcataaacataagttattttggttaatacatttggatcatggtcagagtcctgaatgtgttgccaaggcaaacatggctattggtggggtaaggggctgagaagtatctatgcagacacaaagtggactcaggaaaagatggagttagttaccttagttctttatataaatttttttccaaacttttttgtgctgttattatagatctagtttaaatttttttatttcattttgttttctacataggagattaacatgggatattgtataaatctaactgataaggctgtagaagctgttctgactgcctgtcctcagatatgtatacttctttttcacggctgtcccctaataacaggtcagtgtgacaggttacttgtatttaaatcttgacttcatcttttaccaacttgcatatacaacatattataaaatttatctctgctaattttaccttaaatattgttctggataccatccggaaataatcaaactggtatttcctcttctatttttaatagaaaccaaatcaggaaaaaaatttacacagtcaatagaaaaatgattcttagacaaaagcttaatatttatttatttatatgtatatgtgttcacatgccatggtaggcatgtaaagtcggaaggtaacttgctggagtcagttctctctttctaccataggagttttgggatcaaactctgcctgtctcagtgacaagcaaatttactcactcatggaaccatctcactggccccaaacagcttaaataaataccatagaaagtagagaagtatccaattatgtgacaacctttgtgtaattaaaattttgtttaatgctttaaaaatgaaataaataccataacacttaaggataatgaaatttttaaaaaatatactacccaagggatatgggaggtggtgtgcatatggaggcaaaaaaaaaggaactaccccccccaaaaaatgagtttagaggcaaaaaagtaccagcccccattttgtgaagctgtggaagttaagcctggattacattggagatgccagagcccaagacatctgcaaaggagagctgcagacagggagtgaaccagccctaaagagaactaagttctaggcagcaatgctagagaaatggagccatctaagccctgacatctgtcatggagctacaacatttggagtgtgtccctatttagtctcgtatttcctcactatgcccccattcctcccttgttagaatggtaagtatattctgtgccactataagttggaagtatataataagcttttttattttacaaggcttacaattaagagagtgcactgggtgtacacacctttaattctgaaacttcagggacagaagcaggcagtttgaatttaagggcagcctggtctctataggaagttcaaagactgccagggctatgtagagaggccctgaagggggtagggtggggggattgctttgaatcttccaattgactctgaactttgaacttttaaaaagtgttgagactgaaaaactgtgaagacttttgaagttggaccaaatgcattttgcattatgatatggacacaagcctttgggggccagggtttgaatgagactgatactcatatgttcatgttcatgtttgatgtttgaagacgtgatctccagttggtgaaactgtttgggaatgactaggaggtgtggccttcttggaggaggtgtgtcactaagggcaggctttgagggtttttgttttttcaagacagggtttctctgtgtaacagctctggctgtcctggaacttgctttgtagaccaggctggcctcaaactcagatctgtctgcctctgccaagtgccaggactaaagatgtgcaccacctccacccagttagacttttgagtttaaaagacacaattcacaggttttctctgtcttcctacttatgggtcaataagtgagctctcagccgttcatgctaccattcttttgctcatggatagatagactctaaccctctgaacccataagcacaattaaacactttcttttataagttgccttggtcagggtatttcatcacaccaatagaaacattagctattacacatcaataaaggacaaaaatcatccaaacagaacaaccacttgagaaaaatctagcacacacatactccatatcctgataagaggcatctgttaaaagcccagttaacagcttcacctacagagaaactcaatctcaaagaccaaaaaaataaacaaaaaataatcaaaaaacaaacaaaattccccagttaacactgtgatggacccgtagaaactgttattgccgaaaagcactgactcctccgttgggcctgtacttatgaaaagcagaataaactctggatctcagccttcattttacatttgtacattttacattcctttacttcgggttcatcacctgtttaatgcggcagagttaagtgtttgaacgcctacctgaaatctgaggtcctctgtggtggtttgaaagaaaatggccccaaaagggatcggcactattagaaggtgtggtcttgttagaggaagtgtatcactgtggaggcagtctcatatatgctcaagatactgagcagtctctcagaccactttctgtcacctgtgagtcaagatgtaagaatgctccagcttcctctctagcaccatgtctgtctgcatgccgccttgcttcctgccctgataatggactaaacctctgaaacagaaagcaggccaccacaattaaatgttttccttcataagagttgctgtggcccttcatagcaatagaaaccctaactaagaccctaacagaggtgagagtaactgagacaccatctgtcagcttgtatcatattctattttgttcttcacctgaaagttgccaattattgtcccaaacctccagtcatcttggattccaggaacagatctctaaagttgaaagaattctcagtgaattctccttagagcctccaaaaagaagttcagacaggccaaaccccaattttagtccaatcagatccattttagtattctgccctttaaaactgtacagtaataaattggtactgttttaaaccactgaattaggtgcttgttacagcagcattggaaaactaatacaaggtaaatacattgagtttcccatgttaaaacccaagcaatcgtaataccattttgcagttgctattgcaggttttgttaaggatttttgaacctatattcataagaggtcttgatttgtttttgttttttttttttctttcttcttaacttccttccttttgtggtatctttgactatatttgatgtcaagacagtagtggccttcaacagaatgaactgagaagtgcttcccttccttctacagagtctctccagctttgaacagaagttctcagtgtgttgtatctttgtccatttcattacttttaacatgtgattttgtttattggggtgctggagttatacccaggaccttgcacatgcttagcaagcactgtgccactaacttacacccctaatctgactgtattttttttctttttaatttacttttaaaaaaaatgttgtatgttcctatgtgtgaggtgtgtgtgtgtgtgtgtgtgtgtgtgtgtgtgtgtgtgtgtgtgtnnnnnnnnnnnnnnnnnnnnngtggggagatatgtagatgcttgtgtgcctatgaaagccagagataaccttacttgtccttcaggagtcatccactgagacccataccagcactagaattacaagtgtgcaatatcttatttttctgtttttcctttttttttttttttttttttttttttttttttttttgagtcagggtctctcaatgtgtagatcagcagagctacatggaaagagcctatctcaaaagaaaaaagtaactacatttttgggtgtgctaaatctaatgatagtgaagagtaacattaattattaatgacttattcagttgtatactgtgctttggattttaaaagtacacttatttaccagggctggcaatctagctcaggtcttccagaggacccaggttcaattaccaatacctccatgatgtctgtaactccagttccagggaatctgatattctcttctggcctctatgagcaccaggcacacaagtgataagcacataaaatttaaaagtaaatcaacattgtttttcaaaacagagtttttctgtgtagccctagctttcctgaaattcgttctgtagaccaggctggccttgaactcatggagatgcacctgcctctgcctctcaagtgctgggattaaaggcgcacaccaccatgtccagcaaaataaataattttttaatgtgctttaaaaattacatttgtttgtgtgtagaggggtgcatgtgtcatctagtgtgtgtgtagagatcagactattcattcaccagccccattgtgttttatatttcatgtttttaatccttccaataagcatgtaatagctgtcatcacacctagattttattttttgtttatgctaagacagcatcttatgaactggatctgccttaaattcctgactctcctacctatacttcccaagtactaatattaaaggcatgcattatcacacccatcttacatccagtttatatatgaaacattaaatatcttttattattataaattaatatattgttgttctcttttatagatcattctcgagaagtcttggagcaattagtaggatcaagaaaacttaaacaagtgacttggtctgtttattgatctttactgaggctgatctcaagaacctgtccaggatatgctctataaataacttgtttttcacttaacactaatttattattttgtcttagttaagctgtaactcccagagaatcagttcaatcttattttaaatgtttgtgcttttaagttaaccagcctcagcattttggcacttctattatcccctgttggtttgatgagccatctatttattttaatggtgatcctggtatgtgtgaactgtacttgatggagaggaggctgggtttgtttctttaataacaaaagttcaaatgacttattttccctctatagtcctttctctggtgtaggtatttgagctgttgtaaaagacattgtgggtagaattctaaataaagatgcttttaaaagcgtaattactttctgagttgacttctggcttttacctacatgaaatgttcatccaaaagcaatgtggaacatatggcctgttacctcttcacagaaagagatatacttgtttcactgaaatcagtagtaataatttgcccattaaaatgagacattcagctgcaaaagtggctcagtggtatagcacttgcctcactttagtgatgctagggttggattctcaacaccaaaaaaattaaaatttacaaaaagaggggtgggcagccattcaacatattcgaagtactgaggcttttactcactcatttcattgatcctttccctgctcagttctagggcttgatctcagggcctcatatataccaggcagacatgctaccactgagctatatcccaaggcaatttcattgggttttatggctgctctttccaagtacattttgttcatctgtgagcttcttccttggcaaaactggattcatagtgtgtggtgttttactaggtattgaacatagggttccatgcatgctaggtaggtgctgtaccattagactatctccaattccagaagtgtgtaaaaattaaatatgaaatgctattatagagtttggtgtggtggttacacattctagctctcaggaggcagaggcagaagcaggcagatatctgtgcgtttgaggccagcgtgttctaggccagctagagctacaaagtaagaacctgtctcaaaaaaaaaaaaaggaaaaaggatcattatagagattaagtttactgaagctctactatttcacagcaagttcattcctagcagtcaataaccagatcatccttttgtttataaccagttacagtagtaatctgtaataactgcccaagacttgtattgaaagctagtcccccatgcagtaatgtccataagtggatcacgagatctctgacctcactaatgggttagttcattaatggattcataactgaatggacttttgggaagatggggttcatgagaacagctgtgagccaatttttcatacctcttttatagggcaaaactgcagggtggggattttgcaagcaagcacagttacagaagcaagacgaggcaattaaggaaatcttcctagaacactgttgttcctagaacattctgtggttatgctgggagggggcagcccaagtctgataaacacaaacttaagttttacagtagacagaattggtttcctgattacaaaatggagttgggctgatttcctcatcgatgggaaacctaggaggtgggactttgttggaagaaaaagtcagtccagttaggtccttggagggtttatgttattcctggtcccttgctctctctgcttcctggccaccataatgtgagaagccacttctactgcacactgttattaccacaatatcccacattgcctccacacaaaacaacagacccaacagagcaaggatcaaagcctcagaaactgagccaaaataaaccacccatttaagttgattttatcagctattttgttacagtaacagaaaggtaacaccccagttccttatctttccagagatattttattaatactgcagcaaattgtatatattatatccatacatatagatatactttctacataaccagttgtatatgatacatattattcacatttttgtttagagtacagtgttttgctgttataaaatcctgataacctagtatatgaaatgggaacaaaccattactaactttagtaagccatatagagtcatccaaggtgttaaagcaaaggaagaaggaattttttctctctctctctctttttttttgagacagggtctcactgcatagctctggctgtcctagaactcactgtacaccagggcggcctcaaactcccagagatccacctgcctctgcctcccaagtactgggattaaaagtatgcaccactatgcaggactgtacagagaaaatttcaaataactttctccatgagatagggtctcactatgtagttctggctgtccaggaactaactgtagacccgtctggcttcagactcacagagatcagcctacctcagcctcccaagtggtagtattcaagcctcaagtcaccacaccccaatgaattgcattccttaaactgtacctccagcagaggaaataagagttcaatacaaacagaactgaacttgaaagcactctgacaaatcagggatgaaaatcccacactgcgcttgtggtcagtccactattatcctgctgagttggctctggaagagtgtattcttctaatttgtgtagctgatgccgaatactgtgtccactgaactggggcctcccagggtcaccaatcaatactcgggttctgtaggtccaaaagtagttctccagccacagatgcagactgtctgcaaggtcttcatcataaaacatatctccaagaacaatgagatcaaacttaccttgtttggtactcaaaatgtttttggttaaaacaggaaaaggattcagtccatttaatttgcaatttagtgtaatcgccattcctgcaacttacaaaacatgataaatcagtctacaagaattatatcagtaggctatttttaatttcttattaaggtgtttaaaaacaccttttttcccacatgaactctatatttcattttctctttcagcccaagctttctcaaaacataagtatttatcaacaatgattaatatgaattctacataaggagttctttaacatataaacaattttattctctttgagtaagatgaaaaatttaacagacaatatgcctctttctctactcctcagaaaatagtatttagaattttttccaatttagtaattgttaatgtattattaaaaattcacaaaaacatcctgtaactccatgacatataagccttgtgtatatagtctgtatcatttgctatttagacctcttaaccaagatcttaatactgatgaggaagtaatttgtcacctttttgggaaagagaatgcctgtcatatcatgcatttaaaccttgcataaatatttgtcttcctagaaactgccatttttacaaattgcaaaagtcagtgggggatagtctgagtttctgtggttaaacaccttttttaatctaatagaggccagtgagatggctttgcaggttaagatgcttgacactaaatctaacaggagttcaacacctgaaggccaggcgtggtggcacacaacttcaatccaagcactcaggagacagtgacaggcagatctctgtgaatttgaggctagcctggtctatatagagagttctaggacagacagctaggactacacagaaagaacctgtctcaacaaaccaaacaacaaacaaagagtttaatgcctaaaacacacatggtaggaagaggaaaccagatcgcacaagctgtcccatctccccatgggatgtgcactatggcacacacacacacacacacacagatgaataaataattgtaaaaaaataacctaattaatacttatctcctttgttaaaagggattttgttgttgaatttaatttaactttatttgcaatggtgttttatctgcattaacgtctgtgtgagggtatcggatcccctggaactgtagttacagaaagtagtgagctgccacattggtgctgggaattgaacctgggtcctcaggaatagcagcctgtgctcttcaccactaaaccacttctccagcccctgttgttttttttttttttttaggcaaagaagttcaaagtttatgtcagtacaaactatatactggctgggcatgatgatacatacctgtcgctccaagactagatagtatacaacaggaagattcctgcaagtattagccaacctggggtacaaagagaaataccaggccatgtaggtctacagcctaagaccctgtctcaaaaaacaaaacaaagaggcttggcatggtgttgcatgcctataatcccagcacttgggagatggaaataggaagaaatccaaggtcatccttagcttcatagctagctgaggccatcctgggctatgtaaaactctgtctcaaaaaaaaagaaaaaagaaaagaaaagaaagaaggagggaggaaggaaaaaaggagggaaagggggagagggaggggagaagagagggaaggaagaggaattggtctaggagagaacaggttatccctactccatacccttctcccagaactacaccctgcttgacagaacagtttctcccttctcagaaacgatgcttgtaaaatgtttaacagactagtgttcctccttccttggtgggaaatgatccctcgtttaaagtaaaaactgcactagcatgcacctgatatgatttaattgtggtcttttatctttataaattctgtggtgtttaatctaggggctgagagttcactgtgacaaaagccttctctcaatctctagcttaaataaagcactcttatttggccttatagtcatggtggtctataaccaaagaaggacctttttaaaaagctatattgaatatagaagagcaacagtgggatttttaggaccattttctgggtctttttgtatgtttgtttactgcagacagaaaaacaattgttgggcttgattaagttacaagtgaaacctcttaataaaataagacccctggagggccctaccctaaatgaaggtaggatcagaaaaaaaaatcagatgaactctgtagtctacttgactcagcctcctggggtgctggaattaaaggtatgggctgcctgccatacccaatacaacttgggtcttttttttttttttaagatttatttatttattatatatacagtattctgcctgcatgcatgcctgcaggccagaagagggcacaatatctcattacagatggttgtgagctaccatgtggttgctgggaattgaactcaggtcctctggaagagcagtcagtgctcttaacctctgagccatctctccagcccccacaatttgggtcttaatgcagtaaaaatatccactaaagacacaaagttatctctacttggactttgtgtcatataaacattactgacacattccagggaattctcaacccagaagctaacatgcatgccccaagtttgtatccctctggaatatctgacaaataaatccaatcctcttgggggaatgcactgtcagttcaggccccagataatgtcccactgaacacacctcgaagtatcagattacaaaacaaggcaatcagtgatcacaatgtatcctgaaagggggacagtgagctttaaatgttttaaaatatgcagtccttactggggtctatgtcattggccaagatctttgatgcaccactcatcttagcagcaattgctgttgctccacatccgctcccaagatccaagacagactttcctctaacaacatcagggttatccaaaagatacctaaattagaaagaaaacagaaaatacctgagtatgggaaaagacagtaagaaaaataaataaataaataaataaaaaataaaccaaaacaagcaagatggttcagcagataaaggtgcttgctgccaagtctgatgacccaagttcaacatagtggaaggaaagaattaatacataaaagctgtcctctgaccttcacatgcacaccatggcatacctgtgctacatacacaaacacacaaagcaattaatggtaatttttcccccatggtatagaacctacctgacctagaccatcggtaacatactactcctggggaacaggaataccttttgtttgacaactatatacccttaagacataaccagatgaactcatgaacaacactagagcaaagagtagatggacatgctaaaagtacttaccctatgccaggcagtggtggtgcacacctttaaccccagcactcaggaggcagagggaggtagattcttgagttcaaggccagcctggtctacagagctagtcccagggcagccagggatatacaaagaaaccctgtcttgaaaaacaaaaatcaataaaaaagtatttgcttttgttttagctactatttcttaacaaaaagaatagttgcagctatatgaaaaaaacaagatggacaggaaggagcttaaaaatgcataatcatggcactggagaaatggatcagaggttaagagcactggctacactcccagatgtcctgagttcaattctcagcaaccacatggtggctcacaaccatctgtagtgagattggatgctctcttctagtgtgcaagcatacatgcagatagagcactcacataattaaataaataaataaatcttaaaaaaaattttaaatgcagattcaagtcaaatgcagggtccacctaagatgtcctggaactgccacaaaacagaaaatcccaaatgaccactcatacttcctgtgtgctgaaaaggcagtcctaggagagggtggaatttacagtattagaagcaagatcattggagggttgggtctttaagatccatctaggaactctgtactgactgttgatttgcccatgaacttgaacacaaagtaagacatatggatcttttatgaccatgtaggttctttagcagttgacattagagtttcttgtggggtagaagctttatttatggatattcattaaaaatcttgtgtaaggtggtgaaactatgcaatgaaacaccaaaggtaggatcaaactactatcaaaacaagactttggggataaggagtgatgttacaaaagttagtatgagggctggaaagttggctcagcggttaagagcacttgctgctcttgtagaagatccaggatcaagtcctggaactcacatgacagctcacagctgtaactccagttccagaggatctgatgacttcttccagtcttcacgggcaccaggcacatatgaggtatacaaacatacattcaggcaaaacactcatacacaaaatagataaatccaaaagaaagtttcaaagaaaaagttgcttagtggcacatgcctttaatcccaacactagaaggcagaggcaggtggatctcttagatccaggtcagcctggtctacagagtgagttccaggacagacagagctacaatagggagtccctgacaagaaacttttaagggaggatgtgtttactttgaaggaacaatttggagatataaactaatctatcacggaatgtctggcagtagggggctgtggcagtagacatatgagattgtttgctcacatcagtaaaaattatgaagaaaagaattctaggactcagctagctttcttcttttttgtcatccacattcaaggtgggccttccctcagttaagcttaactggaaatgtcctatcttggctagcgtttggtttttttgtttagttttgtttttgtagacttgacaaatgcctccaccagactggcctgttagcaagcctatgggacattttcttgtttaatgatttgctggagtcaactaacaccagggtccaggtcccaaagaggaggtatggagtcagtgaggtaaaggaggagacaggatctgagggtgaatctgttatggctgctactttactgtagctgcacagaagattaaatgggaggaggagggcatgtgagcttggctgtggcttgctcacatcagggactaaggaagttagaattggccttaacgagttaatagtcaccacagtcatatgttaatgaaagggccacaagttcctcttgccagagataaaaatgactcactttttaacaagaagggactttcttcaggcccctgagggaataggggctgtcttaagagtttttattgctgtgaagaaacaccatagctgtgggggactaaagtatttccgctatagaatattttgagatccagcctttggtctcactaaacatggagcaccgaaagctccggcccactattgtattgttaatgccagtagggctactattgtttagcgtggcctcaaggtaatgtgcctcttatttgcatctctgtgggcctaagcatctgaacaggccctcacctggatggaggggctagaggtatatgagtaacttgtgaggatggaaggttaagagttaggggcgagtggccagagcagagaggggacaaagagagaaatggttccctcgtggtattggcaggatggttaagaaacaccagaaaagatggctaataaagaaatgactctagttccacaacacggaactgagagctctctgaagatgacaagatgcctgtgtttgatctttatcgccattgggttgctgggagcttccaggttgggcgcttccaggtccacacacccccactcaggcggaacctcatggctgtcgtgggttaaagctgaggcaagccgggtcacgacacatagccatggcaacccttataaggaagacatctaattggggtggcttgcttatagttcagaggttcagtccattatcatcatggtgggaagcacagcagcatgcaggcagacatggtggtggagaggtagttgagatttcctacatatcacaggcaacaggaagtcaactgagcataggaaacctcaaacaccaccccccacggtgacacacttcctccaacaaagccacactcactccaacaaagccacacctcctaataatgccactccctataagatgggggccaattacattcaaactaccacattcaaactaccacattctactccctggcccctgtaagcgtgtagccattatcaggatgcaaaatgcatttagtccaactccaaaagtccccttggtctatcacagtctcaacagtctcttctgaaaatcatgccatctcttatctgtaatcacctataaaagtcaaaataaagcagatcacatactgggatgaagaccccaggcccttgcccagacccctgccttggtcatccctagacatgacaggctgcagaaaatacaaagcaggatacagcaggatgtgctgtacacctgacattgtacagtgccccctgaccttgtcctcattgctaaaaagaaaccgaaatatcccatatatggtaaggaaccaattaggagctaacagactctgaatgtgcttccccataaaagtggaatgtagtaaccacaacaatcacccaagagatagcaatctccctgcagctacaactaaccaattaaccacagtcaggtgtccccagctcagaggtataccaatcctcttagtctgttcctaggcagtctatatcccctaacccccccttgctttaccctcaatatataccctaccccactgctactctgggtctctcctactccaccactgtgacggacagacacgtgaccaggtgccaactcacaattaaaattctttgcttttggatcagatttggtctctaggtggtctttggggtccagatctgggcataagaaggatatacattaccattctgaaattaaggaagggcgaatagtggggaaataccagaccaaagcaaggccaaaacccagctgggtaaactccaaattctgcatttccatgtctgatgacaaatcactcttcaggtccccaaatcctttcagctactttttttctcttgggctggttccactcctttagcagctctcctcagcagatatcccatggatgtggcatctccaatattttggttctctaaaacagtcagacttcaccttcacagcttcacacaatggcctctctaggcctctattcagtgacacctctgacacatgcctggactcagagactttccttagtctcagggacaaattccatagcccctttattctatccctaactccagaagctgccaagttctgccgcttactggggctggacatggcctctttgttagttacatcttcatcaattttctgtccttcactgcctaagcttggctgtcctgaaactggatctctagaccagacctcaaactcacgagatctgcaggcctcagtctcctaagtactgagattaaaggtgtgcaccaccacacttggctctcagcttctctttaatgcctttgcacaggttggaagatgagatgggcggggtcttgccctgaggtcactactccctttattttatgtaatatcccgctcttctctaatctgctgatctccctgaatataggatttagctctattccacttcctggtgccccttttctccttgaactgtacattttgtatttctccttgctcagcttgctccttttcattataaatcttcatcagagttaacactaataaccatacaacagacaactaggctgttttgagattccctctaccaaaagaattaatccaaaactcttcactttagcctcaggcagactcttcagacaaggacaaaaagcagccacattcttcaccaaaatatcacacggacaaattctaggaaacgtactaaaatgcttctaggaaatatcttgatctagccatggacaatttaaatcattatcagcaccattgtcttccatgctccatgcttaaagcattcctaacccaaacgaccaaagtccaaatccccacaaacaaaccatggtcaggcctatcacaacaatacttcagtccctggtaccaacttctgtcttagttaaggtttctattgctgtgaagagacaccatgaccatggcaactcttataaaggataacatttaattgaagtagcagcttccagttcagagattcagtccatcatcatttgtggggagcatggtggtgtgcaggcaacatggtgttggctacatcttaaacagaaggcaacaggaagtagactctgacactgagcaaagcttaagcaaatgaaacctcaaagccggtccccacagagacatacctccttcaacaaggccatacccctccaacaaagccacacccactaacagtgccactccctatgagattatgggggccaattacattccaactaccacaaggtcttttgtctaaatgcctgaccttgggaaaaggactttcttgggggactagacactccattacagattacagttttttatatagcttttatagttacagaatattggatatatagttttatatatccaaataggtaaagcttaaagtaagcaaagacaaagctagacaaatattactgtgaaccttaggaatttatatatcttatcaaatatactttatttatcaagcatattatctaaattttctagcagcttagtattaacttgtgtgggagtaggcagaattatcacactatatggttccacagtggcagagattttttttccaaagaatcattttgtttaaagaggctgtcattttatgcattttcatccttcaaagcccatacaaaatttcccaaagggaaaggcagaagggaactctcataacacatagtgagaatcattaaaaatgaaagtgaaagggtgctggagaattgtgatccacaaagtcgaaatgctggaactttgtcaaagcagcaatgatccttgtggttcacaccaatgattgatgtgggagggcccagctcactggggcaatgcactgagcaggtgatcccgtatggtattagaaagcaagctgagcaagccatgaagagcaagccagtaagcagggatcctgcatggcctcggcttcaattcctgcctccaagtcttgagttcctgccctgattttccagatgaatgggacatgacctgaaagtataaaatgaaataaaccctttcttccccaagttgcttttggttgtgcttttttttttttttttattacagcaatggaaactctaacaaaagcataccctcataatcatgcccagaggtgtgtcttgtaggtaattccaagttcaactgagttgacaacaaaggttacccatgacaggtgtgaagagaacaactttgttnnnnnnnnnnnncccccaacccccaaccccacccatggcaactgtgaaaatcaagaatgtaaatacacagagactaaattttttaaagaaaccattggtatatatcacagggcagcttcaaactcctaaccctcctggatcagcttccaaatgctagaagtacaagtgaagggaccagcgctgctccccacttttggcagccatgacaagctaacgcatgcttgcctgaccttgctgggaatgccttggtcactaggaggccagatgcctcgtggcaaggaatcaatcagaagttagctaacaggaccacgctttattgctctgaatgtgctttacggacaagtgcacaacaatgacatgcagagcatagcaaccgccctgggaagacctatgggccataacaaccaattgaccaatcaacacagggcaagctgtccaagcctggaagcacagcaatcctgagactgtgcgtacctctagacactcccctaacactgcccttttaagatccctgcctcatggtttctaggggtcttttctctaaccatctgctgcagaggatagatgaaaggcccgagctaatggggttagctgtttaaacaactgcaataaaagactgcttttgcattgaaatgggcctcttggtgatttttgggttcagaatttgggcacaacacaaggatgtacacatcatcacgaataactacataggaggcctttttggagatgactatatcttcccataggacaaatcctcttctacgagaggattctacaaatacaaatcttctacaaatcctttacgagaaggaaagcaacccataccatatacaagttggaacatgtgagccccagtgacttccttgttttgctgttatgctaagggaccagaaagaagggaatggaggtgggggtgggtgctgagagaatgactcttcaatagccatcagccgtaaagattcacatttcagtgagacatacctagacagggcctggccacctggccagtagattgcccagtagggatcactgtagggccacagctcagccctttcccaccagaacttgcacctgggggtcaaaagccgtaactggatttcaggggtaaggctaccactgctggtgacttcagtattctcctccaggtaggctttcatctcagggtccaaacagctccctgctgtcctccaggaaatcagagggaacccactgctcacagcctgcaggaaactccaatggctccttgaagttttccaacccagtctgaaagccattagtacttctccaaatctcaggctgtcagtgttgccattaaaaggattgttccccaagcagatacaatgagggtctgcctctccacttagttgacactggaattttggatctctacaacaaacaaacaaacaatactgaaaattcttagtccatatccttcaacataacaagaaaataagcaagtgtatgttctaacaactcacaagtacaagttcatttcagaggacagctttggcttatcaatttgggtaaagaaatccagttgctttttttttactgtgtaatccttttagtaattcactatgacaaaaatacacagacattttattttacaacaatcttcaagaaaatgaaataaagtatacctttttggcttttttttttttttaggatagacttgtgtggtgatatattgtttatgatttattaaagccactggagatcaaaatagcaaagcagccacactctttacctatagaagctaggcagtggtggtacacacctttaatcccaggactcagaattaagaggtagacagatatctgttagttcaagatcacactgaactacacgaaattaacccagtcctaaaagatacagctcacacaaaggtgatctcagcacctgggatcacacgtctttaatcccagcacaatgggtggagacaggagtgatatgactgggcagagaaaggaatataaggaagaggagagagaaattgagagccttttgcctctgagggtttgtggagacaggattgccatttcagctgggtaaaggttaagatctactggcttggctgctttgcttctctgattttcagcttgaagctttaactccaatgtctgtctctggatcttttatttttccttgctttggggctaaagagatagctaaccagttagagcacctgatgctcttgcagaggacccaggttcagttcttagcacccacatagcatatcacaaacataactccagttccaagggatctggtgccctctcctggctttgttgggcaccagacacagacagtcaagtacacaggcagacagacaagcaggcaggcaggcaggcaggcagacagacagacagacagacagacagacagacacacacacacacacacacacacacacaaggcacatgcacacccacatggtacatttatacatatgcaggcaaaacactcatacccatcaaatatagacctgtactgtagcctaggcggcattggaattcactatgtagaccaacctgacatcaagcttgcagttaccctcttgcttctgtctcttgaatgctgagactacaggcatacgccatcatacccagcatggatttcattgtaaaaggacaccagcttctaagttcccatcaatactgacttgactttaccaaacctaaacttaaaatatttataacccaaagtacaccttggtaaggaggaatgaggaatacctttttttgtttgtttgttttctggcacaaggtctattatgtagctctggctgtcctagaactcatgcattgaactcacagatatgtgccactatgcctgccttgttgctgttttaaagatttgctttatttatgcgtctgtgtgtatgtgactgtctgcaaaggccagaggcaccagctccccttataggcagttgtgagctgcaggacatgggtactgagaactgaccttggtcctctgcaagagcagcaagcgctcttaaccctgagctatctctccaactctttgttgttttcagatggtctcatggctcagattggcttccatctctctaagcagagaaggatggtcttgaatttctggttctccaacatcacaagtgttctggtgccactactccagagttacttgtgcttggggtcaaacacaaggcttcacgagtgctgggcaagcactctaccaattgacccttaacaccacagcattacggaattactctgtatttggacaacatgtcttcccagcactgacagtttgcttatgaagaagttataatcaaagtatgttataagaaagctagcaggctgggcatggtagtgcacaccttgcctttaatcccagaacttgggtggcagaggcaggcagatctccatgaaagaaagaagcagggatttaaaaaaaaaaaaaaaaaaaaaaaaaaaaaaaaaaaaaaaaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccgcctggagagacggtgtgggcagtaagagagcttgcttctcttcttcaggaccagggtttggttcccagtgccaatgtcccgaagtgtgtacttgtaactttagcttctggtgacacacattcccgtctccacagacattcacatacacacacacattcacacactcacacagacacccaagcgcgcgcgcacgcacgcatacacagataagtaaacaaacaaataaataaaaaggttaaattccaaacagtgcttgtgagctcgttactttcctcagaaaaaaagaaaaaagaaaaagaaagaaaaaaaaaggacaggactatacttttaaaaggggtagtgcggttcttgtggccttacctgattttgctggagtctctcgcgcaaacgaaaaaaaaagaaaaaaatgtacacagagtttcctttctcgggagaggaagacagctggaaaaacacagagccgccgccggaacttnnnnnnnnnnnnncccccccccgccgccaggacacaccagctccgcctttcttcctagctgtgctttgttctggggctcgctggctacccaaggcagctgggaaagtgaaagcccttctgtaaccttgagactttaagaatggggaaagtggccccaggtcagtccctgtagacctggagcgcaactgcacagcttgtgtacgccgtgtctggcgaatcctgatttataaaacctcctgcagaattgtatgcagccccactgcgtgccaagcacttttaagagtaagtgcctggataggtgggtaaaccttttatgacacattcaattgctataaatcataatatgcggctccactattgtaaagtcacagcctaaggctatttttcagcctgtggggctcaggttctgaatctcttaaatccacctttctagtgagtttagatttcccactggcccctcaactcacgactccaaaattaacccatctcactttcattaatgaaaatatgctatgatgtacaagaaagaaaaaataccccaaactaaaaaaaaaaaaaaaaaaaaaaaaggattaaaaaaaaatctgggacaggcgttggtggtggatctctgtgagtttgagaccagcctggtctacaagagctagttccaggatagcctccaaagccacagagaaaccctgtcttgaaaataaataaataaaaagaatctgagtggtgatggtacttgcctttaattccagcactcaggggtcaaaggcagatagatctctgtgagttcaaggcctgcctggtctatagagtgagttacaggacagccaggactacacagagaaaccctgtcttgtaaaaattaattaattaattaattaaaataaaataaaaaattttaaaagtctgtatttgtggcttgccctcttgtctaagcatgcttgtctaactgcttgctaagcatgcagttgtactgttatggggtcttttgcttggatctcaaatagctcaaacaacaagtcaatgaaaaaaaggttattataatcaattctgctaactgatcaataaggaacacagaacagaacagacttgggagccaaactgtcacccgaaaccagaatactacagagattttaacacaaaaaccacaaataaggttttcaccaattaggattcagggattggggactttcctagggacattactttatggttcacttctgttctcactggttggtttgttcacctatggctatgtggcttaacccacatttatgtctcaacttaccaaacaggttgtcagttacccagggaggtcttgggaatttaaactttatttgacccctactcaaaatggaagttttactttaaatggcttacattgcccccttgtctttacattattcaaatctttgattatctgttttagagtataagggattgtattgggttcttaggaccatgagcttaacttagttaactctagacagaacaaatttaactaagacattgaggatacaacgccctatgagaagcagaagagaaggaggaccagtggtcttgctaaggtggtgagcaaggtggttggccaaggggaacaatcaaagagattctggaaccagttactggactgtctcctttgttcctccctattcatcagttttgttttacttttgctacggtgtcttggacgagcccagaatgcttggcataaaaacaacaagtttcccacaatgccatacagagacctctgtccttaagaaacgatagatccagtcctcttctgttttgtagggctacttctgccagggagtctgtttttctaactgtcacatggagaagtaaaggtggcttaggtctctgtctgcctgctggcttaggagttggaggtttttgttttggtttgctttggttttttccaaccaccaggaaggctattcccaaaactgttgagccagcaatgccagttcctacaagcaaaggtaggagctgaatgagatgggctcttcagaaatgagtggctccaatgaggattatatcagctcaacctgctggaccattgaagtatagaacctgagggatgatgtaaacaagaatacggagttcagatttgtctgagaaatgggttagagctacacagtgggtaataccagacatgcagacaaaacaaatgataggtgaactcatgagaatgctagccagtttccttcaggctccatcttttgccatggatggagtatgtatagttatcattacaatatgtcccataatgagatttggtcaaagaaaaagctgtcaatctcaagcaagttcctatgccctggatatcccctaatgtaatagacacatgaatagaccaaaggcatttatcatctgcctggcctaaggttatcgtggtgatagatgagtctttccctggtgtgggtatacttgcaatccctacattgtggtgatattattcatgatttattaaagctagcctgaggattcagaaagtgaaatcagccagaagccatagaagccaggcacacatctttcatcccagcagccaaaagctaggaggtgatggtaaacacctttaatcctagaactcaggattaagagatagatggatctctgtgagtccaaggccacacaggatacaagagattgaatcagtctaaaagaaaaaggaatcacatgcctttaatcccagcactagaggggtataaaagatagaagcagagtatgagttattcattctccacccacactgaagatagcagcattcattctccagccaaactgaggagaggcagcaatttgagacttggtgaagagctcatgcattgatcagccctttcagcctaagatagaagtgagagctagtgaccagctgctttgcttccctgaccttcagcttgaaccccaaaatctgtctcttggtcatttattaattcatgttatataacataataaaggagcctagggtctaaacacagtcaatactaccagagctaaacctttagtccaagactttctgctttccttttaatggttttccaactatctataactaggagcctccaggaagaataacaccattataccaagtaacagccccaaatatattatcatttgcctcagatgaatggtatgtttattcctactaataggacccacaccctaaaattccagaatagtcttagataccttctatagtaaccaatatgctttaatggcctatattaattatttatgagtagttggtatgtatatgacatatacatgtgtatgctggtatacttgtcaaagattgtagagtccaggggttgtcagactcaatcagttgtcttctttaatcccttctataacttattgtttcagattgttttttttttctatgaacttggagctccctgctgcagctagactgctggccagcaagccctagaatccacctctcttctcctgctcccctcttctgcccttccccttcataactgaaattctagcacctggttatgtgtctgcgagaagggtagaaggaatgctggagtttgaggttagccagtctgaactatataatgattatcaggccagccaggactatgaagcaaggccctttagcagatacccctacctacctatccccatgcacagaagtctgaaagctggagctggggagtagtagagaacatgcctaccataagtaagaacctggttccattcatcctgaccaccatttaaaaaacaaacagccaggcagtggtggcgcactcctttaatcccaacactcgggaggcagaggcaggcagatctctgtgagttcgggaccagcctggtttacaagagcaagttccaggacagcctccaaagccacagagaaaccctgtctggaaaacaaaacaatacaaaacaaaacaaacttagcttcccctgattatatccaatagaaatatcatttagcaatgtcattgcatttcctctacacagccttcatgaaggcagaccatcttaagccttttctactttttggcacaatatagaaagtgctagaaattctattaagcaaaagttaagagcaggtatatgtatagttagccaacattaccaggctaattgctttcctgttcctgtgacaatatataatgaaaaacaacttatagaagaagattgtggggttttttattattatattttctggcttatggttcctgagccagaatggcaggggaggcatgatagaagatgtccagagcaaaaaggtgaatgatcacattttcaatagcaaggaaaaagtaaaaagagctaaatgtaagtgaggctaggatactgtcttagttggagttctgttgtgaagagatgctgtaaccatggcaactcttataaaaaggctgggcagtggtggcccatgcctttaatcccagcactgggaggcagagagagacagatctctgtgagttccagatcagcctggtctacaagagggagttccaggacaacctccaaagccccaaagaaaccctgtcttaaaaaaaaaaaaacaaacaaaaactatttaattgaggctggcttacaatttcagaagtttaatccattgtcttcatggcagctcatttattctgagccaaatgtgaaggaccatggaatgggttattctttgtgacacatttcaccatgaacatgattacatgaatgttcacagtcacagatcaagacgaagtaaagcattttccacatacattggtgggcatatcaggtagacagagttatagcaaagtgagaaatctgttctgtagtttcagatgctgtcttatatacatttttagcttttagggtggtggaagctaatgcactacaaagttcatacacattcattctgaaatcatatatagaccacactggcatactgatgtggattatccttatctccttcaaccagcaatgtctgattatgtttccatgcacttaccagatgtcttaattagggcttctattgctgcaatgaaacaccatgacctgtccaaaaaaaaaaaaaaaagttatttaaaaataaataaaaaagccgggagttggtggcgcaggcctttaatcccagcactcgggaggcagaggcaggcggatctctgtgagctcgaggccagcctggtctccagagcaagtgccaggataggctccaaagctacacagagaaaccctgtcttgaaaaacaaaacaaaaagaaaaaaataaataaagtaaaattaaaaaaaaaaagaatatgccttgagataaggatattgggggattgactataactcagtcaaggacttcagggataaggagaaaatttatctttacctgtcattcttgctgttaatctaggtgtccctgtgtctcttttgtccctcctgagacctctgctctgggacagagcatggcttgatgcttcagactatgaattctagtattaaaaggacagaccgtgacctaacagcacatgtctgcctgttacaccagcaaagtacactaaaaataggaacttttatcccttttattcagtttggggatgaataattcagtaaattggttctgaaggttacttgcctgagaaactcccatcatgtccttctgattcctttacctttcctctggagtcacctagattccatgattgataaacatctttataagctgggtctcaaactacccccaagtaacatgagcttgcagggcctgctatatccagatggggacaaatatccatgattgtgaggccttaccctagagcagaagcagtcatctgaggagaaccagactgttccctcaggagatgacagagataacttcctcaggaccaaatctgagacaataagtaacagaacacaccttcactggcaatgctgagtgtcttgaaagcgctgtttgacgaagttccagtgcttggacaactttgagtgacccctacacaacttttgcttgttctgcctcagaaacatggaactatcatggacaggaaaagattttgattatgaaactaatgacaagttgttgtgcccagactctgaactcccaaaaccaccaagagactagatctgatgcaattgaattccaacgtattgaattcaatacaagcctagacagggacctcatccaaaaacgccctaagactcaattgcagggggtttataaaggcaaagatcaaagaatagagttaggggtaccggttcaaagctgattggctgcagagtccagggttttatctcttgtaccatttgtgtccgtaaaagttgtttcagcttttcagattggttgctccctggggttagggccatttgtctccccttccagcctgttggggccattcgaaggtttcttcccttccagtttgttagcttttccagagggggtgggtatggtgtaagccatcttcacaggtcatggggtcaggttctcacatcctgccgtttttgaccctttttctttagaatggttctgggatggcccttcaaagcctggtgcccttctgaaggcaaagcaagctgtttaggaatcttaatgttcttctcccctttgcaggattgcaataaagagaggggtcctattgaaacaaaggtttatgacaaagtcacaaaaggaaatatggtggctcagtgacttttcatgtcaggacttttctgatattgtggaaaaaataaagagcagaggacaacacttcaaaaaccaaagggaaggatggtgggcttacatcagatataaaagaaaaagaaaacaaaattaaacaaggcactgagggattaagttcccaaagaaagatcagatattcattatagtagattaatcaaataatacaaggtaagtttgatataacaggtggtaggaaataacttctgatctgtttacttagtcaaacttagagacatcctgtctagaatgtctgtagctggaagggtttatggcactgattttaaggaaaaagacattgagttaaaagaattgattttatcagaatgttagattttaggtctcatgaaatttgctgtttactcattttgcttcttttactttgatacgtttatctaatcaaggaagactttagaaaaagtaatgtaccatgaaaaggctttgtaatcaatgattacagtctatgaggaactgattttgtgtgtataaataaagtctgtgagagttgcaggctgtcagagtaggtcagaccatactaagatgtgctccctctctatccttctcccataaaagaactaaaaatgtccacgtctgtggctgctcttggccactaagtctgagtattgggcaaaagcctggagatttggatgaaccacaagactcctggtccttttctgagagaatgtctcccacctttcttgtggagcagccttatatacaaacttacaaaaatcccaggtcaaagggttcacaacagaatattgatcccagtggggtgaggtcaggaaaacaagaggtacctgtggttatgctggaaaacaactcttagagaccccatgggggctgggttccaacatctcccccttctttatatataacaaaatagttatcaagtaagaactataagattttaaccattctatcttagtgtgttactataactatcttcaactccatcaaagaacatagaaggataatatataaactctagaactgacagagagacatcttgcttcctagacagtcaccgaaagtttcttggtaacgttggggcatccatcttttgcctacaggcaacaatgtatctggcagacttctcagcaaagcaggaaattctaaactgtccacctgcattggcagtttgtctgacatcttttttctgtgtctgtagaatgtctggcagactctttcatgaagcagggaattctaaactgtcctgcattgacagtttgtactccccatgaagcaggaaccctttaggcattttcctgtgggtcctgcatgtccagtttataaagcaacagttaaaagagtagcttcttgcccaaatggctggtcttgccatatcaaagtcaaactctataacaagtttcttggatgcccatcttcctctcagatgtaattggtgtgccaggagcagttgtgtctcactgtcaagaaaaaccctaaaccatttaaatgccatattttctgtaggtctttgaatggtatgaagaatatctatatatctagaaaacctaactggtatcaacaaatgaggatccattccaatacaaaatatcatttctatatcatattcctcttttttccttttaaaagtgattgactgtgaccactaccatttctaactgaccaaatttaaatgaaaaatattcagatcacctgggcctaataccataccagcccttcaccctccatggaaataaaagcagaaatttccctcccaagtaacctgtactttcccaagtaacctgtgctttaacaactgtttctccttccccagcaattaacgatttaaagacaacacaatagcattcttttgttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctgtatggtcttttgtagggcctgggtcttttctttatccacttggacatattttcctttctcatccgatgcgacagatgatgtggatggcttgcgatgagggctctgggagaccggctgaaagtccagggctatgtaattcacattgccagtactctttttggagctaggttgttagtgccactgggtacaggggatgaagactttgggttctgcatagaaacttagttctcctcactgtctctggagtctgtgctggtgatgctttgtgtggagatggaacggcagtactgagagaaacaggagttaaaggtgtggttgactgagaaccaatacttggtgacaggtgacttgaaaggaagcccattgatgacagtgttgtttctcaggtcaaggggtattggtgcaagtgttgatactcctgaggttcactgatagacatggcaggctggatgtggcttgacacagggggctggctagagtgtgaaggagataaggactttcttgctcggagcaggtgctgactggagctgctgaactcagctggagaagagcagagactatgactgaccgaagaaaggtttctctgggtgtcagtgctctctttagtctgactgaagccacagatctggcagatgctctggacccacctattaatgtcagcctctgtctcagccacaagatagaaggtgagctcattggacttgatatcctgccggggtttcttggagtgttcattcttgtagtagtcagaacatctgggtcaccattcatttgacctctccgcagaataaaccagcatttcttccaagcatagtgccccaactttttctcaggaggtgatttctccagccagcgcacaacacatcattgccggctgactggagtcctcaacaggctcaagtggacaagagcatgggctgctgggtcagctggcagctggtgcacagctcaagagggagggattcctcagtgaaggatttcccgtatttctttaataattttcttagcattattacttaatccaaagttaaaatgaaatcttaccagtaccttgtctctttaaactttctctgtgtgattgactgtgatctctattccaatccaactctcttaagagctgaggcaccccttttccagtcttttgccaatccaactccctcaggagttgaggtacctattttctagtaccttttgcaatccaccctcacaactccttacttgctttccagccttctgcgggtgatctctcagggtcccctttctttcccgatctcagtgaaacctccatttgtggctgctcttggccactaagtctgagtattgggcaaaagcctggagatttggatgaaccacaagactccttcctggtccttttctgagagaatgtctcccacctttcttgtagagcagccttatatacaaacttacaaaaaccccaggtcaaagggttcacaacaggatattgatcccagtggggtgaggtcaggaaaacaggaggtacctgtggttatgctggaaaacaactcttagagaccccatgggggctgggttccaacatgtgtctgatttcacccctcttgaacccaccctgccctgtggtcccctggagctggactatggcacttcatcatgaatgcttaattgtgcatgcctcaattatttctctaccaaaaccatgtctccattggtatctaacttgttccccaagtcaggtctagttatccatccgaagtaagccaactagaagagccaaattaaaatagaagcagagaacggagatttattcaatttgactacattccaaagaagaacaaagagatccagtgaactcccctcagagtccttcttcagggtgctggaagtgagactggtcaaagaaggatgtcatttgaacatcattatctggggttttgtctcatcctgtaaaatggtctggcaagtcattacaactttccagactgggcattggtggcacacacctttagtcctagcacttgggaggcagaggcaggtggatctctgtgagtttgaggccagcctggtctacagagaaaccctgtcttgaaaaaccaacaaaaannnnnnnnnnnnnnnnnnnnnnnnnnnnnnccctctctgactgggaattttctgtctcccaaaagacattgttatgcccaggacttgggaccttttgctaaaaggtagcttatgctttaggcatatccagaatagtagtgaattgccatcgagcacctcctttaaaggtcactgtgtggtgttgagtaagccagctggaacacctcccaagcatttgagacgtcattaaaggttgattacaccagcgggaggaatttttccctcattagtaaggcttgtgtgccatctttttctttgttgcatggaatgggacggaagaggggggataatctctcaattgttcttccagctcctgtgtcctgagtaactgctggcctcctgagaatgccaatgccctgatcgtctgaatcccctccctagctcccatggtagtggaagaccatcatacccgggaagaaataatcttgtatcagaccagaagagatttcgggatcaccgctgctgttgttgccgctattgccatatttcggacattgccattgctcagtctgcttccaacgaagaaactgttaataaccttgctggcagagtcagcgaggccctggccatgcagaataccctaaattcccatattcagtttgatttctgtaaaaaatgtttctatgggagtgtccagattgaatgcatatttggctggaccctggaatgattcttttgtaaagtttacctatgttttggctcatcagattgtagaaattaataagatgagggttgttccactctcaggcgagtggtgggggaatgccatgacccagttagggggctgggtgcagtgatggggaggcactatgtcctttaccattatgggagtacttctgctctgtctggggttatttgcactatgcaaagtccagtggaccttccaacagaaggaacagatacatagacaagtcctacttagcctcacccatggttctcctgatagccatgagatttggctacagatgctcactcaacaagagatctgaaggggtctccacgacaggcaacccatgggacactgccccacctaaaacaggagatcaggccctccaatgacgggtaaggggcaggaaagcctatgtgacctaagacggggacccctcatataaaacaaaaaagggggaattgtgggaacaaagtggccctggcagaaacccaacaaccacctccccccaatgcggttgcaaaacatgtttactggagcagaatgttatttcccttctgggaaatctctggcctaatctgttccgagaacaccatgtccatgccctgaacccaggcttgtgactagccgcttcttcctaagttccccctccctcttctggtgctagggtataaaaccaccccaggagaaaaaaataaagggccttcttaccaccaagccagctccctgtgttgttaatcccgacatgctccgcagatgcagattctcagtcccaggccatccggcgcggcaacttccctcagttgttttttatttccccactatatagtaataaaaagacccataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaagagtggatcttactaccaggtagagctggagatagatatggatgaactcttggacatggaaagtgataatacccgggcttctagagtcaaagagcccttagttgactgttacaaacccactgaggccttcatctctggcctgctagacaaagtccggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaaaaaaaaaaaaaaagacccataacaattttcagttttaagttttacagaagcaaaggcagcagttaacacctcacagtccatcatcttattcttatctcacttgcaggagactaggagctcccatgtattccagagcaaaaggtcaacagcccttaagggatgatgcctagctccatattaagtttctgtagtcatcaccagagacctaatgactgagatagattggttcatttctggtcaggcaaaaacatggtgccattgggttagggctggctgtcacatcctcataatatttaagagacaaaacctgcaaattttggccatttagacacatgggcaattgtcacagttatcttgaaacagagcaagccaggccagctgttaacctgggccatgctgcctgcctggcagaattatgctgtttctgatgagagagagcacagggcttaatgagcagctgttagcctgggcttcttcccagaactgccaggcagaaacatggtccttttgatgcgcaagcagtcctggtcaacagactttaacaaaaacatcctcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggttcaaaacaacttttaaaccaaaagcaatgcttggtgttttgctatcttggctaaatatcaagccaggaacatcctgtctttggtgatagacataggcacccattcccaagaacaacaatatcgttcaaaattcaacaaagcatatttatagaaataagggtgagttgacataaactgtttgcatacagttagcttagttaccactcaataaagctgactcaattcctcatggccagaggtaatttattacccattatttccataacaagaaaggacaaccctgggctggagagatggctcagaggttaagagcacaggcagctcttccagaggtcctgagtttgattcccagcaaccacatggtggctcacaaccatctgtaatgagatttgtgccctcttctgacctgcaggaatatatacaggcagaacactgtatacataataaataaataaataaatcttgaaagaaagaaagaaggaaagaaagaaagaaagaaagaaagaaagaaagagagaaacaaccatgatttacagctggccattaggctcatccctgtgtcaaagaacacacctctaataggcttggagaggggcctgggtgtgtatggggagggcaggcacatccaagattaagtcctagtctgccactaagttcctgtgcttttaccaagaaaagcatataattctgtcaagtaggcaagatgaacctgggtaacaactatgtgaaaagaacaatcctggggtacttaagaagtaattctggcatcatcctttgctgtgtaaatctcccctctgcccaagtagccagacttgtagtctctatttaaattgttcaaagtgtaacctggggttgggtcctgaaagagatttaaggatggcagtgtatgtagaaagtatacactgataacattttgtatttaagactggttcctttattagccagaaccagtcaagggctattattaaagaacgttttgttagacccccggaaaactcaggcctccggggtctcagcccaggaccttggtcaccccaatcaccaggcggattcgaaagcttgctgcaaactgcatgaggctttattgttgtttaacgagttagccccatgttagctggtttctttcagccccccgccatggtggatggctagcaaagacagctcgaaggggctgcatagagatcttgtagggcagtgtaaggggagtgtctaggagtacgcacaggctcaggaatggtgtgcctccaggcatggagggcttgccctgtgttgattggccaattggttgttatgacccatagaccctcccagggtggttgctatgctctgagcgtcattgctgtgcacttgtgtgtaaagcacacccagagccgtaaagcatagtgccaccagctaacttctgattggttccttgccacgaggcaggcatctgacctcttagtgaccaaggcaaggtcatagcgagcacgtgttactgtcatggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatagttggtcatgatgaccagtctctggagattgttattattaatagtttccaaggaatattattatcttcaacaactgtctggtttctaaaaattgttatgggttaccctgctccagagcacccaggttttaaaaataagtcaagtcactctgttccctgaaaaaccactagctattccatggccttgcaggtgtaaaaaccaaaataacattccaaacccctcatgggcaaaattgtaagttcagttcccaaccaatcagtaaatgactcatgtatgttataaccaatcaatatgttgtcacactcctgcctagtgaccaaaaagatataaaaactgcctgctttagaaactcggggtcgatctcttctcagagaaaagagtcattctcttctcagagaaagaccccaacacattggaataaaatccttttgcttttgcatcgaacttgtgtcctgtgagtgactcttgggctgtgactcccaaagttggtcccccttttgggcccaacaccaccagtgccagcaacagtgaccgaagaaccagaccaggtgagagtctgtggattaagaaggacacaactcaggtcattccatagaaacgaaagccatcagtttattgcagccagcagtttatataacaagaggagatggataaataccacttgctagcagaacgcattcccatgccccatcataaggaaaccacaacccccacccactgcaaacaaagcaaaaaggggatgggggcaaggcaatgtttcaataacaagaaaggttcataacaggatgttagtgggcgaggcttagaaaaacaggaggtgcctgtggttatgctggaaaacaactcacagagatcccatgggggctgggtcccaataagctggggcatttgccctacccttctccaccccacccctttttgggggggcactgtaatattacttataagttgaacatttggtaaatgctcataattgtagaaatgaatagtttagtaactatcttcttaataaataactcagttcagtcttacaactcaagagttcagatgcaagcaatggataaattaaattatatctgttaagtttcaaaactgagtcaaacgctgaagtgcctgcatctgtactctccagcccaaaggctgggctgtccttcctccagaggctcttccctatataatccagacatttgggttacccttcttttttagactattggtctgctggcagctgtacctggttcctctctttgctcccttcacctccccttctctgcacatggtccagctcagcctagttgtgtccactttggactcttccagatgtccctgcccctggttcctttattagccagaaccagtcaagggctattgttaaagaaccttttccttgttaatctctaaatgtgcttttatctacaataaactttctcctccaccatacctaagagtagtcatgttctttcctttcctttttcctttttccagtacccaagcaagtgtgattgcctgtgcaatccaagaataacctccacaccaactcctgcaggaagtttgatttactagatcttaattcttgcagcttctctctccaatgaattgccttatgataaatcgctagcatgagctttgtgggtatctgtgaatttcctgtttgtttcctggtctggtaacagcacaggctcacaccggtaaaccattactgtagaaagagctgaaccccacccaatctttagctaactgatggtgtggtaccacctagtggtaacctaatttaatgagcacaaagtcctacctaaaaaaagatttttaaaagacaaaacagaaataatgaaacagtctgatgtgtaaagaacaaagattctagcaggcaaaggtgcgtgtttctttaattgtaagatatggcagaaatacttattactgataagtagatatgccctaaagtttaagagcaattttgtatcatctataacacattgttttttccctctccctcttgtaagcaccacttcactgatttaatacagttgtcccctaacccttcagtttccacccttcctcctttgctctttcctctacagaaaaaccacaacaaccccctttcagaagccagccttggcgaccccccatgcctagctagccgccagccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacagggccaccccccccccccaaaaaaaagtagagcccagcaaatggaaggacaggctcaaggatggagacttgaagagtagtcctggcaacatagcaatgaaaggccaaaccagagccatcctagagaaaaagggccaaaaacagcactatgtgaaaacctgaccccatgacctgtgcagatggcttacaccccccccaaaaaaaaacccaccaccaccaccaccggaaaagctgacaggcaggaaggggagataactacaaacaggcgggaaggggagacaaatggccctgaccccagggggcaaccaacctgaaaaactgagaagcaacttttctggacacaaatgggtacaagagataaacctatgaaaagtccccaattccccaggactctgcagccaatcagcttcaaacctgtacccctaaccctattctgtgatctttgcctttatcaacccctcacttatgagacttgagacctcctcctgcagctgctgtgccagtctgtggaacgaggtcccttctggaaaggtctaacatggaggataaatgcaagttatgaaggtctgagaatggaaggtataaagatctgaaaatggaaggtctaagatggtaattaaggtgcatgaattaaagttatgaaggtctgaggataaaaagactcaagtgatgataaagtgagttgagacattaaaaagaatgaaatatgatcctgatttctctatttctcatgctactgttcatagtcagtaaagttctacaataccactagaggttcataactacaaggtcaagattgaaaggttcaggcattatgctggcctgcccctgttacctggttgaacaggcagtaccctggtcagcccaaggttccatgggaactaagtctgcacgcaggtgtagaggacccctttaaaagataggcccctgcccatttacgctctctgttcctctgtctctctgtttctctgttcccgctctctctgtttcccgctctgtctctctatggcgaccagctatggcagtcagccatttacccctgttcctcttcttggtctccccattctgccgggccttataataaacttatagtcttatgtctcatgtctcagcatttctcttttcttctttttaaacaaaacaataacaaagattaagatgctttttattatcctaaaaaaatctgtcaattttaaaatgttaatgctttcagccaagttgcttctaacaaaatatgctgctaatatgtctaatacttatgtttccacaaactctaaggattattgtaagttccagggagccgaattggatccaaacaaacaggggagattcactccagttattcaatcttcccctggtcccaggactcccttcccttatcttgggacacctcgggaacccctccctcatcttacaatcttccctcaaataccaggacctaagaaaaaaaaatttctaaattcaaccttgtcctctgctctgccaacatctttccaggcctaagaggctccagggagttccatacatcccgaactgcaatgaaacaaccatctaccccaggacgtggcagcaccccaaccttctcagatcccccaaagatggtcaacgccccaggtcagcaggaatcagccttgagatttcttcatccctacttccctaacctgccacgcccaattcaccaacttttataataaaccacagccgggattgtaagaacaatacatttggatgaccccacccccctaacgacaggtggggcacgcacaggaaaacgtgctacgtcatcaccaggtcacccacaatgcattatggcctgcatgagaactctgcgcatgcatgaaacctcagtgcgcatgtgcagccttcccccccttctccctctttgactcctcttgggttggctgacaacccaactccatcctccccctcttctggtaaataaactccccatgggttgtccatccttagcttcctttctttacaactacagctgcagcttaaaagaaaaacaccttcgtaggcttgaattaaaacaaaacaaatctttgtgcacttgcatttggtaagtcggctccttagtgatctctcttggggtcttgtggactaggcataaacaagcaaaatcccatctcaaaataaaattttaaaatttatctcaaaacttaaaaaaaaaaaattgtcattgttaggtcacaaagtaggccccagaatggctgtgctgtagacagtgtcctaagatgacagcctgggtccagcccaggccagattcttatttcataaatagaaacctaactaaactcagcattccagggctggagagatggctcggccgttaagagcactgactgctcttccagaggtcccgagttcaattcccagcaaccacatgatggctcacaaccatttatagtgggatctgatgccctcctctggcataaagttgtacatgcatatatacagctctggatatgtatatattgagaaagagagggggggggagtgtgtgtgtgtgtgtgtgtgtgtgtgtgttgggttgtttgtcaggaaagccactacttcctttctctgctcagcatctagttcctgattaacccaaacaacctgcagcagctctaggacttccccattatcacttaaattccacttgttttcccactgagcaggtgctctcttttcccagagctcagcagtttgtcacccagcatatattttacctacagaatggtctagttcagtggtttgtcccctttctcagaagtccacatgacttaaataggaagaaaccagagacattaaggtacagtagggataactagtgtttggtaagctagtcgggatgacattgacattgcattgaatgcaactctctccatctccctcctccctccctttctgccttctcaactctaacttgctctctctttcttgacaagatctcaagtctttaaactcactatcacaccccctcgcccgctaggattatgaggttacaggtatgtgtcatgatgcccaattcaagtatgctagagattgagcctcagagcctgtaagcaccaggcaaggactctaccaaacgagctgcatctccaacacctatctatcttcctcctcccagcctctccctctccctctctctttctgacatttttttaaaaataaggtctctctctgtgtgtcttagctactctgctattgctgtgagaagatgctatgatgaaggcaacttataaaaagaagcatttgcgggctggagagatggctcagaggttaagagcactgactgctcttccagaggtcctgagttcagttcccagcaaccacatcaccatgctcacaaccatctgttataagatctggtgccctcttctggtgtgcagatgtacatggaagcagaatacataataaataaaatcttaaaaaaaaaaaaagcatttgccaggtgttggtggcacacacctttaatcccagcactcaggaggcatcaccatgctcacaaccatctgttataagatctggtgccctcttctggtgtgcagnnnnnnnnnnnnnnnnnnnnnnnnnnnnnnnnnnnnnnnnnnnnnnnnnnnnnnnnnnnnnnnnnnnnnnnnnnncctttaatcccagcactcaggaggcagaggcagtcggatctctgtgagttcgaggccagcctggtctacagatctgtcaggagacagccctggttagatataaaagtctcctttacaagaggcttggggacctccatctaaaccaccaatttagtcaagcaccccaccccttaggttagtgttctgagataaaccacaggaatgttcccggacacctgcccaggcctgagggcattaaaacacccactcctcccccttccttacttcctctttctttacttcctcctttctctttaaaaactccttgcttaagttcaataaacagaccttggcaacccattgcttggtcttgctctttctttctctcccatttagtgttctgagataaaccacaggaatgttcccggacacctgcccaggcctgagggcattaaaacacccactcctccccctcccttacttcctctttctttacttcctcctttctctttaaaaactccttgcttaagtttaataaacagtccttgacaaccattgcttggtctcgctctttctttctcacccatttattttcaggcttagtccccctcgagactcacgaattaccagaaccccgagggcgggggcacagatcgagttccaggataggctccaaaacaatacagagaaaccctgtgttgaaagaagcatttaattgggtacttgtttacagttttagaggattattccatgattgtcatggtgggaagcagacaggcttgtcactggagcaatagttaggagctttacatcctgatgtacagacagcaggcagaaagacacacagtgggcctggaatgggcttttggaaccacaaagtcaggctggagagatggctcagaggttaagagcactggcttctcttccagaggtcctgagttcagttgccaacaacatggtggttcacaatcatctgtaatgagatctggtgccctcttatggcatgcaggcatacatataggcagaatactgtatatataataaataaatcttaaaaaaaaaaaagaaagaaaccacaaagccaacccccaatgtcatacctcctccaacaaagccacacctcttaatccttctcaaacaaacagctccactaactggagaccaagcatgcaaatacattagcccatgggagccattctcattcaaaacaccacagtctcaaagctcacagcaattctgcctcagtcccctaaatgctggaattaccagcctacaccactacatgaccttaaagtttcatttccattctaatatctgtaattctagagaaaacagagagtcacccatcaccctcttccttggtttccttttctgaatgagttcctgcacagatcaaagtagaaactgtatataaaggacagagtataccgtttcaggtgatcccaggtgtgggcatcttcactattaacagtggcaaatgataacctttgacctctgtgtctgtctgcaggagacacagaaagttggtgagcatggcaggttaccttctcatctttccacaaggcatcattgcaacagagtagcttgagcttgttgacaagaaggcttctctctcaccttcaacagcaccacatattttgtatactttattattagagccattggttgctgacagttactcagctgctattttcatttagctcccttggttgtgcacctaccatgactctcaattaaaattcctaacagaatccaagtctgaaaccagctggcctcaccctatccatttcatttcatctcccattgcttggcccccagaaagctccactccagccaggctgagctctttatccatagggaacctatgcattcctgtgttagactgtgtgctggaaatagctctctctttctcatcactgagtttaaatccagtaatgggatatgacttgctgtttaagtgcattgctcttgaacaagtgttctgtttgagatgggaccccactatgttgaacttgtccttgaactcctagattcaagcaatcatccatacggtagtcccagtagtagctgtgctatcatttctagtttactgcaaattaacatcaggcaaattacttgatctcaatctctggttgtcaggtgtggtggaaagtgcctttcacctctgagccatctttccatcttatttatcttgaaaattggcatttgaaaaaaaaaaaaacagggtgggttttaaatggattatgatgaattttacaggtgaaatgacaaatctgggaacttgaaaggttgtggaggttgatactcctcaaccttcctaatgactacaaaactttaataaagttcctcatattgtggtgatcccctcccaccaggccatgaaattttcatttgtacttcataactgaaatcttgctactgttatgaattgtaatataataattttggagacagaggtttgtcaaaggggtcacaacccacaggttgagaacctatgatctagggttcttgttgctttatcttggttttataaagtcctgtttcgttcaacatcttgtgtgacttttttttttgttctgcccccccccagccatcactagaaatagtttagtatctatgaatgaaattgtaagagaaatagaagaaggcaaaaaaaaaaaaagatatattttatttaaaaggatgtgtaggactggggaatgtaggcctatggcatagcacttgcttagcaattgcaaggcctaaaattcaaaccccagcacagcaatggcagtttaaatgaaaatgtcccctataggctgagatgtttgaatagttggtttttagttggtggtgatctttgtgtagctttaggaagtgtgtccttgcctgagaaagtgtgtcattgagaatggcctttagaagccgggcagtggtgatgcacgcctttaatcccagcactccggagacagaggcaggcagatctctgttggctgtctctgcttagtgcttgaagttccaggtgtgagccctcagcttcctgctcctgccaccctgtcttcactctgccatcatggactctaactcttggaaaccataagccaaaagaaactcttttttttctttctttatttctttcaagttctttcttttaagctgtgtttaaaggtgtgcaccaccaccactcagcaagaaactcttctataagttgccttggccatggtattttatcggtgacagaaaagtaactaatacaatagcaaaataaaacaaattttcaatatatatatacatgtaggagaaacaaccatctaaattggaattaatgaagatttatggcataaggattagtgggctgtagtagtatggtataattccaactactaggaaagctgaggcagaaggactaccttgagttcaagtccaacctaggttacagagtgaattccaggcctgctggggctacagagtgagacagggccttactcccacacctgtgtgtgtgtgtattctacaaacagaatacaaaagatcatcaaagtagtacatttaggtcttaggtggatgttcaccaaaaaatgttaggtagatgtggtaaaacatgcctataattctaccacgtgggaggcagaagcagagaatcactgcaaggtcaagccagtttgatctacttatcaagttccaggccagtcagagcggctagtaagactgtttttgttgctggttttatttttttaaggcaaaaaaaggagagaaaggtctcaggtgtagttcaagcctgtggcctgatgctccggaagcaggggcaggatgattgctacaagtatgaggccaacctagcctacataaggaatccaggcagatctggcagttttgttagaaacaaataaaacagttaaaacaaaaattggcatctggtgtctcattgctgtgatctcagtgctctgggattgaaacaagagggatcacctagagatcaatccatatcactgtccataccaggagtttcagaatggcctgaactaggaattttctcttttttttttcaagacagggtttctctgtgtagccctggctgtcttggaacatgcgctgaagatcaggctggctccaaactcagagatccaactgtctttgcctcccaagtgcttggattataggtgtgtgctaccacatttggctacttgaactgaagtaaaattaaaaacaaacacccagccaggctatggtggcacacacctttaatcccagtactcagaggcaggaggatctctgtgagttcaaggctagcctggtctaccgagtgagttccaggacactgagagggctgttacacagagaaactgtgtctcaaaaaaaaaaaaaaaaaaaaaaaaaaaatcaaaaccagccaggcagtggtggcccacgcctttaatcccagcactcaggaggcagaggcaggcagatctctgtgagttcgaggccagcctggtctacaaagcaggtttcaggacaggctccaaaactatacagagaaaccctgtctcagaaaacaaacaaacaaaaatcaaagcatactctcaaatcaattcatgtctagcttatgaataaaattttccacttttacattttcagaaatgctatgcatacatgtaaaggggtagtccacacaagtgagctccacactggggcagatgacatgttgatcactccttgctcatatctgcctgccaaggaacatgtcggcagggagagttacattaagcagctcacaaccaactgtgactcccattccaggagatctgacatcttctctggactataagggtacctgcactcatacacacacacacacacacacacacacacacacaccacacaccacacaccacacaccacacaccacacacacacacacacacacacacacacacacacacacacacacggtacataatttaaaaacctttagaataaataaataacagtaaattgtgatggtgcacatctttaatctcaacactctagaggctctatatatcaaattccaggccaactaaggctccatgcagagacactgtctttaaatacagaacatatcaaagcctggagcacaaagtaagacccaagtcaaaagaaagagggggaataaaaggaagaggaggaaaatgaagaggacaatctgctgtttagttgtttgccaactaacagtctactagagattaagaatgtcctttgtctttttgctgcctccctaacacaccttctcaaatgtttttaaatgtagtctcaggtcagttaactcacttcactctttcaagagcctgcagaattattccagtcagtgctgccctggaagcttttacctgctggagcaggtgattcacccctttgaaatctgggacaccagatctagaaacctgtccttaacagttttgttttgtgtccttccttccttccttccttccttccttccttccttcctttcttccttccttccttcccctctccctctctccctcctcctctctcccttcctcccattctttctctttctttctttctttctttctttctttctttctttctttctatattgtcaaatgtttaatatacactgtactgtgtaacacgaataaaagacccagagacagatattagggttcaagcttcaagttgagtatcagaaaagcaaagcaacctgccgccagctctcacctctagctcaggctgatccatgcacaactatcaaactgctgcctcccctcagtgtgtctggagaataaatgcctctctgagaccttgcttctgtcttatatacgtccctaatgttgagattaaaggtgtgagcaataattcccttttagactgattcactcttgtgtagatctgggtggccttggactcacagagatctatttatctcttaatcctgagtcctaggattaaaggtgtgtaccaccaccacctcctagcttctggttgctggaactaaaggtgtgtgcctggcttctacagcttttggctgactttgttttctgaatcctcaagcaagctttaataaatcataaataatatctactacaatactgagcttcacatggccattttttaaaattacatgtatttatttcgtgtgtgtgtgtgtgtgtgtgtgtgtgtgtgtgtgtgggtgtgtgtgtgtgtgggtgtgtgtgtgtgtgggtgtgtgtgtgtgtgtgtgtgtgtgtgttgggagaggtgttcacaggtttcagagtgtatcattgctgaaacaaagctttgaaaataacaaggtctaagatgtttttgtcaaatagctttaaggtaaaaaaacccaagaagtggcatagctgagtgatagattcattaggttaggaaaagaacaaagcagcccagttatcattagctggcataccttctttactagggttggctgttgatcaaagatgatgattaattctttgtacccatttctgcactcaatatcctgctattaaaaaaaaaaaaactgttgatgagtgggtatgccccctaaagatttaaggtagagctatttttcatatgtaaaggtttatgtttgtgattcttttaagattcattataagattacctttcaagataagcaataaagtgatgggtccttctttgtaactgcaatatgaagcttgccagtaagagaactggacaagaaaaatactctgcttgctcacactcccctagtctataacaagttgcttggatgtgaatatatgtaggttcctgggatgacgttgtttaatcatgtaagggaaatgggaaacaagttcttttgtttgtttgtttgtttaacctgtattcattacaatcattcacttggaaaatagaatataatcgcattgtaatttttatattgcttgaaagattctacttgggtatataagttgaaaaggtaaaaaaaataaagtgagtttgaagagaaacatcaagaacaaatcaaggaaatcaccaggaaagatgtagaggaaaaataagaagaataaagaaaaagtcagaagaaaacaatcaagagggaatgtatgtcttttcccttactccttcagataaaaaaaaaaaaaaaaaaaaaaaaaaaaaaaaaagttttagtttgcagactccatggaaccctgagttgctggaggctgggccccacagcagcagtgtgtatgcaacctggaatcaagcttgggttttgcagagcaagcaccaccccagtgaaccaactcacttgaccactttcttagattgtataaaattttaccaacagggaaaaataaaagttctatgtccttgtaaaatcatcaaaaccattttaacctgtgtaagtattttaatctatataaaattccctgtcaggggatatagctcagtggtagaatatttgcctagcatgcacatttacacaagaccctaggtttgattcctagtaacacacacacacacacacacacacacacacacacacaggcacacaggcacacaggcccttctgttctacagaatgagtttagctcaacgaaggctacttagtgagatcctacctaaagaaagaacggtggaaaagccaggcgttggtggcacatgcttttaatcccagcactcgggaggcagaggcaggcggatctctgtgagtttgagaccagcctggtctacaagagctagttccaggacagcctccaaagccacagagaaaccctgtctcgaaaaaacaaaaaaagaaaaaaaagaagaagaacggtggaggcagcaagggttgggggggaggggtggagggtacagagggggagaagtactggtggaatactcctggaatactctaggaataatgaacattccttaactttgaagaatattgtcactgtagaagtctctccacagactgaagaactctggctcttccccctacctttagacttcagattatgtcataattagtacctacaactatttataggctgtacttttccaaggttgtaaaactttaatcttcccatatgccacagagagcattaaactataatggtgttttcaaattgctgtatgatattagtcttctgttgttttctttgtttttttttgggggggttgtttgtttgtttttcaagacagggtttctctatgcacctttggagcctgtcctggcactccctctgtagaccaggctggcctcgaagtcatagagatccacctgcctctgcctcccgaatgctggaactaaagttgtgtgccaccacctttagttattgttctctttgttgagagggggtttcactatgtagtccaggctatccttgagctctcatcaatctttctgcctggttcagattgagaaatcagaatttgtcaaaatcctcagcgattacagaacccgaaaactcattttaagatactacaaaaattcttcctcctctttatttgtatgtgtatctagagtaaatttactatcaagtttatgcttataatcccagtaggaagctgaagcaagagaaccttgaataccaggctggccttgggtatatagcaagatgcaagaggaaaatgagaaaaggtagttgcagcttccaaggcgttaagtgcctgtaattccagcactggggaggtggagacaggaacaccaggagtttaaggttgtcctctgctacatagctgattcattgccaacctggcttaagggatcttttctcaaaaaaaaaaaaaaaaaaaagtataaggaggggaaagaaaagtaaaaggaataggaggaggaagaaaagtactatgaacaaagaggcaagcacttccaggacaaccagccattcagagtttctgttatttcctggtacatccagcagtgggagggaaggagaaacaacctgtgttgaaggttgccggcccaaaatgttcacagctatagtcaataaggtttagccctcactgtagcaaagctgagatgtttgtaattagagtcaagtttatgctagatgactgaaggaaagtttgttgctttgggtgctgacagaaagtgggggccttctggtggttgggtatccttttaaaagtttgtttgtttgtttgtttgtgttatatgtgtttgtagggggtaatgagtttcctatgaatgttagaagaaaacttgtgggagtcagttctctccttccactctggagttccctggtgggacaggtttgttcctgtttagtggtaaccactttttcctaccgaacctccaacttgctatgtagccaagagtgagcttgaacttctgatcttgtctcagctgcctgagtgcgggtatttcaggccagcaccatcatgcccctgtgatgctaggattctaaaatacctatggtagagtttagatctaaccaaaccatcaacaaagcagctgcaatgctcacaatagccagaagaggggggtgtttactcatttctgtaattcactctgtggttttctttctttctcttccgtccttccttccttccttccttccttccttcctttctttttttctttctttctttccttctttctttctttctttttttcttcctttttttgtgattccaagcaggtctttaatttttttatttatttattctcactctggagcagtggcagagtggactatcagcctccgaagttgcatcagttccacgagatgagttatgttcagcagcggacatgtgatttccttgttatcacctacctagatcctacctgaacagttcctttttcatgtgcttcttgtctgtaatgataccatcaccaaataaacacccaggaaggtccctcagtgaggaatgaagggtataagtgaagcaagatgattaatttcttcttttctttctttttttttgtttttgtttttgtttttgtttgtttgttttggtttgttttggttttggtattggtttggtttggtttttggtttttccagacacggtttctctgtaacagccctggatgtcctggaactcgctcttgtagaccaggctggtctcgaactcacagagatcctcctgcttctgtctcccgagtgctgggattaaaggcttgcgccaccaccacccagcccggcaattaatttcttattttggctattgtcacaaaaacatcttccttcacactccaatgccaagaggagattcaaccagtctccagtgtggttatctgcagtcaggatctgaaataaagagtaatgaagatgttttccaacattgaaccaattgtgaccttagactggtccaaatttgcatccaactctaacattcactggctgttagagaatgttttgaattagtccaggcctcagtttccacacctactgtagaacaactgaaaaatggtacttaccttttgtggaagttaggggaactaaatggaataacatataagacggtggaaacagcatataggccatagtcagtgtttaacgtgactgtctgcctttgtcatttgtcagagttattttttttttcttggcaagccattggtcccattagaaatccacccagggggtgaagaggccagtgattaataatttgtgcactagatggcactcaaaagaggagctgattgttttgtacttctgggtctttgaacttaaaaacccagacttagtaaaaggagactgtcatctaaaaatactatttaaagattggggagcccctgcagaagaagagggtagctgtttcaacagagaatactgtgatcttttgtcaacaagcactttgtggtttaagcaggttttctgtggtacggaagagcaaacagggccaggataactaggatatgggaagggtgtggggggtgatctgagaatgacccagaggccagcctaggaacacttgtcgactcaaacttagtgagggccaaggtccaggggcctgggaaggaaaagagatagaccgaagtttgactaacaagcactttgctcttggcgatcagtgagagcaagcatctgagctaatcatttatcgtttatcaagcaaagaattgtgagaccttgtgtctgtccttatcctaagcaaacaagaaggcttgttaaagtcctacaggaagggtgggttttgtaggaagctcttttccagaacacagattgtggatgattttttttaaactggttttcaagaatcacaaggactgagtaaaattggacactgacagtagcaacttttatatttcttgtttagtgtattgtatttcagataaaggatgaaatgcaggtgtttgctggacctagggagttagggatatttacacacagagatcctgcttctctggcaaactgccttgtttggaacactctttgcttggcggtgtggcctttattataatttctttctgacccaaaattaggtaaaagtcaaataaaactttctttttgagtcagggtctcaagtatctcaggctgtcctcaaatttattgtacccaaagatggacttgaatttatattccttcctccattttccttgtgctgattataggaatgcagtaacacacctggtttaagaagtgtcagaaataaatccagggctttgttcttgttagaaaagcactcaaccaactgggctatctccccagcatcagacaaaacttaaaatgagaaacatcagcacaaatgctgaaacttcagtttagtctcaaatcaagccaggtggtagtggcgcatgcctttaatcccagcagaggcagagacaggtggatctctgagagtttgaggccagcttggtctataagagctagtttcaggacagttagagttacactgagaaactctgtctcaacccccccccccaaaaaagaccactgagccatctctccagcccccaaaattaatgttttaaaagacctacaaaccaaaaatagtctttgattttattttatattttgtgtagcactgggaattgaatgccaggtccttggtatgttaaataagtgtcttgtccagtgttctgtcactgtgaagagacaccatgaccacaacaactcttagaaaataaagcatgtaattggggctggcttacagtttcagaggtttagtccatatcgccatggcaggaggcatgctggcatgcaggcagaaatggtctgaggtaactgagagttctacatctggatccataggcaaccagaggagaaagagaaaggcagaggtcctggcttggcctcttgaaacgttaaagcccatccccactggtacaccccctccaacaagtcacaccacctaatttctcccaaacagtgccatgcccagataatcaagcattcaaatatatgatcctatggggccattctcttgcaccacaacaagagatctatcactaagacacaccattagcctctgaaagttgatttcaaataagctaaaatggagggtataaataatgaatcaaccatacattgagacatacagacatatcacaatagacacttgaaggcttattagtctattatttgagtgtgtttggaaatttctgtctcaaaaagcaagaatgtgttcagtattttctcagtttttggggatctgtggatgatgtttgaaacagacatacaagataaaagcttgtaaaccgtttcctatttaatttgttttggaatggtttttcttgaaaaaaaatgtgtcaaattgtacatttaaagatggatataaaaagtagtatgtatttaaccataacctcatttatctagattctggaattcataaacactcccaaccatagcaaggagagtaaataataccccctaatttggcctcaacacaactgctgtcatactaattggtactttgtgtagctactgccagcttgtagccaatgattacattgtaaaacattacaagaacaatatttttaatgtcttaaattcacatatacatttagcaatattcccatattttagtaacattttgagccaaaatgtttaaaaattgactgggttctttaatccagccaagccatatgttgctttagaggagtgtccaaagtcactttgactcaactgtgttgataaggtaattgcacatatttttaggtttctagctgtaaattgtatagtgtgtatccctaagataataccaattctttctacgggtaataattgtagctactttataaatagctctaatgggccagcataatggctcagcagacagatgcacttgctgccaagactaatgatctgagtttgagccccagatcccacatggcaaaaagagaaaactcccagggttgtcctctgactttcacatatgtattgtttcacatgttcatccacacacgtagacacacactaaataataaatgtggagctggagagatggctcaatggttaagaatgtttactgctcttgcagagtattcaagtttactttccagtaccctgttgggtagttcacaaccacccacaactccagctccaggggatccaacaccctcttctgacctcctagaacggacacccttacacctgtgcaagtgcacacttttgtacaaacatactaataattttttgaaaacctcataaaaatcaatgttaaaatttataaaataaaaaataaatagttcctatgtgtttatggaaggaacattgctaaaagggtttaaatgggcattttaagcatgaattatatttcctctttttttaattagatttatttattttattttgtgtgtgtgagtatttggctacatgcattatgtgatgacctgttgtctggtgcccagagagaacaaaagaaggtatcatatcccaagaactggagttgctggtggttataagccactaaatgggtgctgggaactgagcctgggttctttgcatgagcaacagagcaacaggtgctcttaaccacagatccatctctccacccctgaattgtgtattttttttctcctgagacagcgtttctctgtagctttggagcctgtcctggaactagttctgtagaccaggctcatctcaaactcacaaagatccacctgtctctaccttcaggaattaaagtcatgtgctgctgccgccaccacccagcttctcagtatcctcataaagtagataccagacataaaggaaagtataacaagcctacaatccacaaccccggagaagctagaaccctcttccagaaacagatggaagcagatgcagagatctacaactatccattgggctgagctcctggagtacaatcaaagtgatggaggagcgatatgagcaaaggagtcaagacccaaatggggaaacttacagaatcagctgacctgaactagtaagagatcattgactccacactgacaactgagaaaccagcataggactgaactaggcctcctgaatactggtggcaatgctgtggcttgggctctatagagagataccttgctcagcctagacacaggggtatgggggtgtgttaagggagtaaggggggtggggggcttgtcttgatactgcctcaacaagttggtgggacagacttagttgacttcctaggggaagccttaccctctctgagaagtggatggggggggggatggggcaagaaggagaatgctaggattaaaggtttgtgccagctgctggctttatttttatttttaattcttatgtttgtttcttgagaaagtctcatgtagcccagtgtaagctcacactagctttatagcccagggtggccgtgaattcctgatcctcctgaatctttgcaagtgccagggttataaaaggcagcacgacacttggtttaaagcttctcttcttttcactgttgttctaggaactggaccagggctttctgctacgcaagcaatgtactgctgactgaaaaccagacatttgatggtgttttctaaagctgagaagataaggcaagcatgtaaagcatgcttaacttttcagtccttagggaatgaatgtctgtaatcccagtactcaggaggcagagacagggggatctctgagtttgaggccagcctggtctacagagtaatttccaggacagccaggactacacagagcaaccctgtcctgaaaatccaaaagacaagattccttgcaatggaaagacaaggaaggtaattgcaggcagataaatcttgaggagatggcaatgtgtccctgaaatggttggctcatgcccctgccactagatgctgttgttctttcccaaccttggttaatgacatgagtcttcagaatcaagcctttcatgttgccctgggttctgttactttaaatagccacctaccagattatagtttttatttgtttgaagattgtcagagtctaatattaattttttttccttaacaaaataacaatgaacaagctagaagaatagctattgaaggtagtacaattaacttggcttttctcccagcgtgtttctggcagctgtttttttttttttttttttttttttttttttttttttttaaaaaaatctccttaagaaagaaagggtttattttccaaagggatagagttcatcttcagcggagaaggtatggcatagtgtctggagcaagaaactagctgaacacattttcatccacatataagaagcagagagctctttctggttatttttacttattgtctgaagctgaagttaaaggaagtaatcatggggataatttttggtctttaaagggggaatttctttctttcttttttaaatgtgtatgtgcaggtacccttagaagccaaaggagggtgttagatcccctggacctggaattgcaggttattatgggtcacttgagtgagtgctaggaatcaagctctgggcctctgtccagaactagacagaacagggctgtcaagaactctacattgctgagccacctctgtagacacagttttttaaaaatttagctgactgaacatagaggtatacacctttaatcccaagacttgggagggagagacaggcaaatctctgtgtgttcagggcagcctggtctacatagtgggttacaggatagctaaggctgcatggtgagaaccaagtctcaaaaattttttttcattaaagaattaattaattaaaaattatgagtatgggtgttttgaccacaggtgtgtctgtacctcacatgcatgcagtgcccacaaaggccagaagagtgcgtgggatcttctgggacaggaattacagaagatcatgaattgctgtgtgggtgctgggaactgaacctgagtctctggaaaagcacccagtgcttttaaccattgaaccatttcaccaacccttctaggccctgtccaccaaaaaaaaaaaaaaaaaaaatctcactttgtggcccagggtggcccaaatctcactgcaatcttcctgactgggcctcccaggtatcccaggtactattacaggcataagccatggtgcttggctaggagagatatagaagcaaagacagagtttatatttttcatttaaaaaaaaatgagaccctttctaaaatgcattcattccataaactatcattaaactaaaattactccctagaaatggagccaaaggatggggctattaacacagaggttaaagactgctcagaagcaggctgagataaattaacaccctgaaaattctaatatttcaagcctaattcaataaagggacggtagctaagttgctaaacttaaaataattgcctcatgaatagtcatattgaattgattatgaccgaagagcatgaagatttgtgttttatatttagtctagatgtatgctcttcactaaggaagctgaggataaatttagtgaattgattatctgaaaaagtaaactgtgggcacgaggagagacaagttcttagcctctggaaatgcaaagttaagaagaaaaactgtcttttgcttttgtggcaggggcttatgtattacagactttttttttttttttgcttgtttgcttttggttttatttgtttgagacatgatctcactatgcaatactgtccaactataaatatatagatcaggctggccttgaacttgtgctcattataatgtctctgtttcccagactcagggattactggtagggtacataccagccctagttaatgtagtgttggcaatcaaaggactttgtatgtgctaaaggaacactctaccaggtgagccatattcccatctccttggggggaaaacttaaaggttatgatccttactgggtggttttgtgtgtcagcttgacacaagctggagtattcacaggaagggagtctcagctgaggaaatgtctccttgagatccagctgtaagacattttgtcatttagtgatcaatggggaagggcccagcccagggtgggtggtgccatccctgggctgctggtcctgggttctataagaagatggttgaacaagcaatgggaagcaagccaggaagcagctccccctccatggcctctgggtcagctcctgtttccaggatcctgccctgtttgaattcctgtttcgacttccttcagtgatgaacagcgatgctgaagtgtaagccaaataaaccctttcttccctaacttcttttttaaatcatattttgccacagcaatagaaaccctgcctaagagatggtctgaatgattatgtcctcttgaagttcttacattgaagcctgcccctcaaggtgatcatactgaggaagtgaggcctttagggagtaattttttggagggatggtctctgtagccaaggatgatcatgagcacctgaccctcctcttcccacttcctaaatgttataatcacagaagaatgacactatgccccgccaaggtggattcttcctgaatggaatgagtgctcttacaacagattatcagctatctctttttttttttaattttttttttatttattatgtatacagtgttctgtcggcatgtttgcctgcaagcaagcaagaaggggccaccagatctcattacagatggttgtgagccaccatgtggttgctgggaattgaactcaggacctctggaagagcagacagtgctcttaacatctgagcccctatcagctatctcttaacccatgtgagaacacacccaaaagccacggtataggaacaggaaacagcccttaccagacagaaactcccaggatctagatctcagacatcctatcaccttgagctgggcacccacagttcaaatcactgttagcatcactgtcttctattaattccctattaaagggttgagagagaaataaattctgttgtttataagccataaagtttatggaacagaataacagttaataaacctgaaataataatatactactaaatggggtgactaattacagatgtctctgaattcagagtgggagacaacagataagtgttctgtgattttaaagaaatcgttaaaagagccaggcagtggtggcacacacctttaatcccagcactcacaaggcaaaggcagtctgatcctgtgagcgaaggcctggtctacagagtgagttccaggacaggctccaaagctacacagagaaaccctgtttcaaaaagcaaaacagagggcatagtggctcatacctgtaaacctagcacttggcaggttgaggcaggaggattgcttcctaggctacatagtgaaacactgtttcaacaacaacaggcaggggagtgataatgcaaacttgttgtttcagcaacatgggaggctgatgaaggaggatggcttgaacacaggctttccaggctagcttcgtggacaacatagtaatacacccatctcaaaacgtcaaagtcaaggtggttacaaggttgttacctgctggaggaggccccacgcctcaagccaggccgagttctctctcttcctgtgcgttcagctgtagatagaaccctcagctgcctctccaacaccatgtctgtcagtttactgccatgcttcccagacatgatgataatggactaaacttctgaactgtaagtcagccctaattaaacattttccttcataagaattaccatgaacatgatgtgtcttcacagcaatagaagattgactaagatagatggtaccaggagggaggtattgtgataggcctggccatgcttttgtttggaggattgtaagctttgagattttgaattagaaaggtagttgaaccctttaatagggaattaatagaaaacagtgatgctaacagtgatttgaactgtaggtgcccagctcaagagatttcagaggaaattattagtaagtggcctagagataattctgatattttggtgaagaatgtggatgttttctgcccttgtccaaaaaaaatctttgtaaagctaaattggagagttttggattaacagttttggcaggggagatttcaacagtctagcatttatgcagatctataatgaaaagtaacaagctgattaagggaagaatacaaaatgtacagtttgaagagaaaaggcacaccaggaatagagctaagtggcatggaccaggtgaccattgctgcttgacgaagttccctcctgattacaccaagaacaagaaagttagagatttactagacacacctaatcccaaggatgaaatgcctacaattcagatccagagcctgaggccattaaggggaagaattcagttaatgaatacagagaaaccagaatggtacagtataatgggaagagagtaaggcatcaggatttcaccttttgagagagttatgaaggggggacaggcccatagaataagactaggagattgtagtacagtgtctgctccccagaagtccttgtcccaagggtctccatcctttggtgggggaggggggcgtgaggaaagttcctgattgataaagcagacattctccttatctctggcagaatgaatttaaggcccttcattaacatatgaatggtgcctattgtcaaggtcaatgcaagattcctcaatccctgatctcaagccactccccatctcacatgctccttgcctcccatctccttttaatactatgtgaagctatagagtataaaaactgtagtcttcttttcaattaaacgctgctagcaaccatcctgattcaccttccaatggagtccatctccttctctctctctccccacctactgcacacatccccaaaggggacctgaaacattacctcacccccccccaacccctactaaagcaggtctttggcagctaagtcttgtgctcaaagagataaatggctcgaagaagagcctgatgttaaatgaaataataggagtgatgacctcagagaaaaaccccacttcctcagcccccacccatatatacagctaagcctccaacttgtgaaaaggatttaaagaaaaacttaaactgggtgtggtggctcagacctttaatcctaacacttcagaggcaaaggcaggcagatctctgcttttgaggccagcctagtatacagacttgagttctagaacagctaagcttaaacagtgaaagaaaccgttgaaaacagaaagctggtgaaaatgtgtttgaatgagagggtcatgtttcagccccccaaagcagcaaaatttggcagctttggttatgtggttctggctttggagtcaaggatacaagaaaggggttgtagaatctccctccatggctaaagaaagctgctgagtccaggcatgcatgtgtcaggggtgtcccttcatggaggacgagagaggccattgagtgaagctgtgaagttgaagcctggattgcattggagaccccaagatgttggtgatgccagagttgtgggatacccgctaaggagaactgctattagggtacataaccagtccgagagagaagtgtgttgctgtcaacaaagctgaaaagagatggagatctgaagaacgctctgccattgttgtgcccaaattctgaacccccaaatcaccaagaagcccatttctatgcaaaagcaaagagtcttttattgcagttgtttaaagagctaaccccattagcttggcctttcatctatcatctgcagcggatagttggagaaaagaccccgagaaaccatgaggcaggaatcttatagggcagtgttaggggagtgtctaggggtacacaggctcaggattggtgtgcctccaggcttggagggcttgctctgtgttgattggtcaactggttgttatgacccacaggccctcccagggtggttgctatgctctgcatgtcactgttgtgcacttgttcataaagtacacccagagccttaaagcaaagcgccaccagctaacttctgattggtccttgccacgaggagggcatctgaccttgtattgtgcagggcaggcccagcaaggtcaggtaagcacatgttagcctttcatggctgccaaaacggaagccggacacacacacacacacacacacacacacacacacacacacacaggacacggggactggtcccttcaacatcagacatagagatgcagtttggagtttacacagctgcttttcagtctagctttggtccagtatttcctcactgtgctcccttttctccgttttagaatgaaaattatattctgaatgttggaagtatgtgatctgccttttgatattacatgggatacagataagagattgtcaggactctcagaggagactttgaacttttaaacagtgttgagaatgttatagactatggggactgtcttagggtttttattgctgtgaagagacaccatgaccatggtaacgctcataagtgaaaacatttaattggggtggctcacttacagtttcagaggttcagtccattatcatcaaggcagagagcatggtggcatgcaggcagatatggtgctgctgaaatagctgagagttctataccaccccccacccccagcccagacagggtttctctgctttggaggttgtcctggaattagctcttgtagatcaggctggtctcaaactcacagagaaccgccttcctctgcctcccaagtactgggactaaagacatgcactaccactgccaggctgagagtcctatatattgcaggcaacaagaagtcaactgagacactgagtggtatcctgagcataggaaacctcaaagcccatccacacagtgacacacttcctctaacaaggccatacctactccaacaaagccacacctcctgagagtgccactccctataatatcatggggaccaattacattcaaactaccacagggacttttgaagttggaccgaatgcatttctgcattatgatatggctaagtagaatgtggtggtttgaataagaatgggccccataggttcatagatttgattgcttagaaaccagggagtagcactattaggaggtgtggccttattgaaggaaatatgtcactgggatactcaagccaggcccagtgtcctctctcttcctgtagatccagatgtagaattcttagctatccgtccagcaccatgtctgcctgcatgccaccatgcttcccaactgtagtaatttgaatataattggtccccataagcacaaagaaagtggcactattaggagttgtggcttttttggagtaggtatggctttgttagaggacatgtgctactgtggaggcagactctgaagtctcatatatgctcataccacacctagtgtctcagactacttcctgttacctgcaagtcaggatgtaggactctcagctccttctccagtatcatgtcttcctgcatgctgccatgtcgcaccatgacgataatgtactaagcttaaaaatataagccaccccaactaaacgtctttttcctttataagagttgccatggtcacggtggtgtctcttcacagcaatagaaaccctatgacaccagccatgatgataatgaaccaaacctctgaagtataagccagacccaattaaatgttttcctttgtaagagttgccatggttgtggtatctcttcacagcaatagaaaatggactaagacagctaccaaacatcaagtgatacaggaagaaaccagatgccaggcattagacgaattatttttctaaacctccagcaggtaacaaccttacaggtagatctctgtgttcaaggtcagcatggtatacatagcaagttctagggatccaggactacatagagaaaaccgtctcaaaagaaaagttgtattgtagctagctcagtggttgtgtgcacttgttgctcttgcagaggacctagcttgattcttagcatccacatcagacatctcgcaactccccatagctccagttccaggtgatctgatgccttcttccaggcagtgcacacacatgatatacatacagacaaacatgtagtgatgcattatctatgatttattaaagcttgcctgagaaagtcagccacaagccatagaagccaggcacacacctttaattccagcagccagaaattaggaggtggtggtacacacctttaatcctaggactcaggaagagagatctctctgagttcaaagccacccagggatacataatattgagtcagtctaaaaagagtaacaggtcacacaccttttatctcagtactagaggggtataaaagatagaagcaaggtctcagagaggcattcattctccagccacactgaggagaggcagcagtttgagacttgaagaactcatgtgtggatcagccctttcagcctgagctagaggtaagagctagtggccagctgccttgcttttctaatattcagcttgaagcttgaatcccaatatctgtctctgggtcattgtgtgtgtgtatgttacacaagcaggaatatacatatacacatgataaataaaaacacaatttttttgttgttttgtttttggttttcgagacaggttttctctgtggctttggaggctgtcctggcacttgctcttgtagaccaggctggtcttgaactcacagagatccccctgcctcttcctccctagtgctgggattaaaggtatgtgccacaatggtccagctaaaaacatgattttaattgtattagttagcaggaaagacagctcagtgaatactggcactcgtcaagcttgagggcccgagttagatcctcagaaaccacatagaaggagagcactgactgactcctgataattgtccagtgccttccctgtgctcagtctccagtgcagcaatagtttgttttgatattgttgagttgtatgagttctttaataaaagtcatatatatatatatatatatatcaagcattttaacacctcttcagctgaggatacttgataatagtaaatctataaaacctatataaggtttatatagaaaacgatttaaacaaaatttaaatcagctgttattggcataaattgacccctttcctaaaactataatggggactggtaaatggcttatcaggtaaagacacctgctgccaagtctgactattttattcattccctaagatctacaatggtagaaggaaaaaactgactcatacaaattttactctgatctccacaagcatgcctatacacacacacacacacacacacacacacacacacacacacacactaataataataacaatgaaataccagagaattcacaaaacaaagatgtaataaaaatgtaaaaaactgaactaatgagggatacagttactggtttcccaaatagcctttgttgtgataagatttttctaaaagccaaaatcttggcattggaaaatgtcactccagatttccttgtggaaactggaattgtgacagcttggcatgtttttaagctaattagaggttaaagctgagattactgactcccctgcaggtttgtccattcaggcagcaattgcacaagggaccctaatagaaaggaagtattctaacatggccctggccgtcctggaatgcactatatgaaccaggctggcatcaaactcaggaagatccacctgcctctgcctcttgagtgctgggattagaggtgtgcccaaccacacctggcctttgagagaacttttcttcagtggtgagtcactgacaaagtgcacatgctcctgtagacaaccgctcacccgttgttcttaagcagctctaatgaaatgcacagatcagaaaagtggatcagcaggcaaggagacactgccaccaagcctgactacctgagtttgatccctaggacccacatcatggaaggagagaaccaacgcctgaaaccacatcctctacctctgcaaatgcgagcgtgtgtgaacacacacacacacacacacacacacacactaaatgtcatttaaaaaaatcttttaaattaaacacaaaggaactaattggctcaccaaaagagttaaagacatgaaagcagaagaaggaaggggatcagagggaatgggagggggaaaagggagggaaatagaaggatatgattacaatctgtacatgaagctggcagtggtggcacatgccttttagcccagcactctcgggaggcaaaggcagacagatctctgtgagttcgagacctgcctggtctacaaagtgagttgcaggacagccagggctgtaaaacagagaaaccctgacttgaaacacaaaagcaaaacaacaacaaaagtacatgtatggttataggattataagcattaatgacttagattttttgttttattagtatattatatataataccgaatttatgacatttccacacatgtggtttgtttcttggctagcacacacaataattttctgctgtatttgcttgactagtttagaatctaacattctacaagaagccaccaacaaaaataggagcgcacatccagtaaaatactttttgtgcatacctcgttataacagaagcaataattgtataatagaaaacgttcgtaaccattacagatatcaaagtttattattttcccagtaacaccaacctgctactaccgagattattaacattctttcattcaaaaatgacaggcaaagtgaggccatagtgctgtagatactggaatgataataagccaagatgcataactaaccacatcccccaccccaagtacaacccagctaagaaggtaagagaagtctttacaagggttctagaggattgttgaagagtaagatagaagctaagggtcaattacccagcttgttaatttgccctacccgagagcctctccccctccctctctctccccctctttctttccctctgtgtttgtgtgtctgtctggtctctttctccagatcctcctgcctcagcctcaagagtgcagggatgatagacgggagttaccacgccccgcccaggactaggatcttaaaatgttttaagcatctgcatgtcggtttaagaagatggttcagacgttgtgggaaatgacctcagcgtgctgtctgccttctccaaagctacgttattgtttaggttgggttgggctacatcccctcgggaagacaggattccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttgcgtaagggtgagacacgtgacacctaccacctgaactttatctgtgtcagtgctcaacacttaggtcatagcctttcagagcatcttctttggatcatagcatgcttcattgattgcaccagtatagatttttttctctctcccattgaggagaggattgggaagactgtattaaataatagatgatagtaaacaaaactgctcagcttttaaaaatacagtcccacgttttagctgagcatctttttattaagacagcttcacagcaagacgtatagttttatttatcgaaaagaggaataatagactaccagccccccccatgtgtaattatgtaatatgctatctcttcaggtaagatttcatgtatgtgttaagaatggcattgttaagggatgtgaagttggggtggggaatgatcagcagagttgttttggagaaagatttctcctgtgttggtaaaagaattctctttcttggaggccttctatgccaagtgactgatgaaagaaaaaagcctgttatttgtccttctctcattgtctactaacacccaaacaacaacaacaacaccttttaaaaaaagtgtgtcctgggactctccagatgtaatgcaaatagcatagaacattttaacataatttaaattttctctcttccttacttttttttctttttgtaacagcaggatgtggtagctcatgcctgtagtgtcaatactttccaggctgaggcaagaggagtggtgtgggtttgaggccaggtgggactacagggtgagataccctgtttcaaaaacaacaaagggcaggggaggtcggagaaacagcgactggggtaaaagctataccaaggaagaaatggctataaacattcgagaaatggcaaaacgtaggcgccagcgcgtgtgcacacacacacacacacaggcacaaagaatttgtgcatttttatttattactttgtgtgtatgccttgtgtgtgtgtgtgtgtgtgtgtgtgtgtgtggttgtgtgtgtgtgtgggtgggtgggacatggtgcatgtgccacaatatacatatggaggactgaggataactttgtagaaccaattcttgcattccacctttatgtgtgttccagcaattgaactcgggtctctagacttgtgcaagtgctcttacacactcagccatcttgggaactctttaatgtgctttcaaaagatggatagatagatagatagatagatagatagatatacatatgtgtgagtgcacacttacatgtacccatgcagaggtgtaggtgtcagcagaggccagaagagcacattagatctcccagagctatagttacaggggcttgtgaggaactgatgttagttctgggaactgaactcatgtcctctggaagatcagcaagtgctcttagcttctgaggcatctcttcatccccctttgacgtgcattttttaaaaaattatatttatatgtgtatgggtgcatgcttgttttctgtggcatgaacatggagatcaaaaacctttaagagtcatttctctccttccaatatgtagagcccagggattgaactcaggtcatcaaatttggtggcgggtgcctttgcctgttgagccttctcattggcttttattataaattctttaggacgacacagctgggcattggtggcacacacctttaatcccaacactctgaaggcagaggcaggcagatctctgtgagtttaagaccagcctgaggtctacaagagctagttctagttccaggatagcctccaaagccacagagaagaaactaaaaaaaataaaaaaataaaaaagtctttgggacacaagttgtgttttcttcttttgtggtaaacatgtaattgacctttctgctcacagtatttggagtgctcaaattatgatgtaattttgcctggttttgattattcaatcgttcaacaaatggatttttaagagcttggtgtagattgtcaagaagcacagggggaacatctgtaaagaaaataaagtccctttcatattggagcttacatactagtgtaaaaaaatagtgacatagatgtcccctttttattttttactcccccccccttctgtactggatattgataatagggcctcatacattctaggcactgaactacatacaaccccacctctttaaaaattttctgttttttagtcagggactcattaagttacccatattggcctgaaacctgcattgtatcccagaaaggccttgaacatgggctcctcctccctcagcccttccccagtagctgagattgtaggctttccataacaggtccagtttctatgtccaaattagtaaagatgtataagaaaaaaatggagcaggaaaatgtcatcagaattgctgttattttatgttattggtggggtcccaccctggaaatgcataggcatgtgctctcatcattgggatacctcagcctttgattttaaatagggggacagcctcacagagaaagtgatatttgaacacagccttgaagaaggtggaaaaagcaagtggaatggactgtccagggcagtggttctcaacaagtgacccccgggtgtcaaaggtccctttctaaggggtcaccaaaagaccatctgcatatcagataacttgcattatgattcataacagtttcaaaattagttatgaagtagtgatgaaaataattttatggtgggggtcgccacaacacgaggaactgcgttaagaggtcacaacattaggaaggttgagaactactagtctaggggaagagcgctataggcagaacaaacagcgagatagcttgaagcagaacagcgattagtttatgtagataactgtaccaggctttgtcttttgagccaccaaccagctcccaaatcgtgacatggaaacttcttattagttatgaatgcttggcctagcctaggcttttatctaccttttgcctcaggctctttacctttctttctatatgttgtacnnnnnnnnnnnnnnnnnnnnnnnnnnnnctgcctggtttctggctccaggcatctctctctttttctccctccttctctgccctcttctctctggttattagatctctcctgcctagctattgcccattcagcttttttattagaccaatcaagtgcattagggagacaaggtggaacagcaacactccttttcataattaaacaaatgccgcataaacaaatgtaatacatccttaaatagttaaatgcagcagaagcaaatgtaacacgtctttacacagttaaagtaatagtccacaacaggaaatagctaggaggccaatgtgagtggagtggccaagatcatagagacagattacgagaaatattacagggcctcaaagacattgctttttactctgagttgggaaggcactgattttttttttttaacagaataattgtatcatctgacacaccttctaaaagaatcactgtctgccagtgagacagctcaggtagaagtggtacttgatgcaaagctgacaacccgagttctatccctgagactcacatagtaggacagaacagatttttacacgttgtcttctaatttccacaggtgtgtgcctgcccgccagcagatgaccacacacacacacacacacacacacacacacacacacacacacacacaaatgtaataggattacaattgttttaaataaaattattattagttatatgtaccactgttttgcctgcatgtatatcagtacaccacatgtgcctggtacccaaggaaacccaagtgggtattggatcccctggaactgggcttatagatggttgtgagctgccatgtaggtgctgggaattgaacctgggacctttggaagagagccgctgctttaaaccactaagccatctctcagccccaataaaccaaaacattaaaaaaaataaaatagatcactgtggctgccaggttacataggtgtgaaggaaaacagtagaagcaggaaacttgttgcatgtttcattatttggcgtaaaaatggtttggggaattggtggtaatgagtcaggtgtgtgtgtgtgtgtgtgtgtgtgtgtgtgtgtgtgtgtgtgtgtgtgagagagagagagagagcgagcatgcatgcatgtgtgtatatgtacatgagcaccatcagaggttattaatgaattgtatgattgtggctgatttctgttttcttttaagatggttatactatgtagcctggaagaccttgaatatgaggcagtcctcgtgcctcatgagcttataagagtgtgtgtgtgtgtgcgcgcgtgcgtaccacagccacttattatgatggagttctattgatttagtagtcagatgaggaacatgatcggttatgactgaaagatttttggcctgaacaattgtaagtttctctgtggaaggaagactaatggagaatcagactcagctttagctcagtttcattttagacatgttaaggttgaagtgcccatttaactttaatggagatgctaaataaataagatatgtctcaggggaaaagtccagactagatataaatttaaagccatgaagccacttgtgtgttgagttaatagaaaagagggggaaacttgatgattgagtcctagggagggggataatccaacaggcacaggtggagagagtgagaaaatacccaaagagattaaataatagtattgacaggaggtgggtgggtaaaggcagtatcatattttcagttaacagtattttccctagagctacatttggagaccaggaagctgtgtattaattagttttctgttgctgtaacaaaaatgccttaggctaggtatgttggtaaaatatgaagtttatttagcttatattcttggaagaggaaagtccaagatccaggtgatcatatggcaaaggcctcataatagcatggcaatggtggatgagtttacaggagagaacacatgattagagaagccagacattcaggttggttagacctgctcttttttaaataataactgactctctcagcaattaaccattgtaaggggtctttctcatcagactttaaactgccaacccccaagtaacgactcggagacttcttattaattatgaaagctttaccttagcttaggcttgttcacaactggctcttttaatttaaattaacctgtttctgttaatctacattctgccacgtggctttttacccctccgccgttgttctgtacatctgactccctctgtgtctcccctagctaattccacacatctagattcatcccctgagttcctctcactgcccagaagttctggctaacctaacctttactgcctagctattggctgttcagctcttattaaaccaatcaggtgccttaggtaggtgaggcaaaacatggacacatattcatacagtgtaaacaaatatcctgcaacaccattccttggataactgaattaatcttttctgagggcaacacctcaatatcctaattacctgccaagaggtctccatcaaagatttcatccattctaaacattgacacactaaagactaagcttccagctagagaaacttttttttgggggggggtgtttgtttgtttgaggcagggtctcctgtagcccaggctgccctctacttcagtgtgtagctcagaatgatctgggaacttcagatcctcctgcctttgcctccaaagtgccagggttataggtgtgaaccaccatccgaggttatattggctttattgattattcgagttctaatcatggcaggtctttagagaggccttctgaagctttactttcctccacacttttttttgttttgttttgttttttgaaacaaggtttccctgtgtagctttggagcctttcctggaatttgctctgtagaccatgctggcttcgaactcagagatccgcctgtctctgtctcctgagtggtgggattaaaggcatgcatcatcaccgcctggctcctggcttaataacccagcttcatttgtcatagcatttagaaggttaatttttaaagatatttttaaatttattttttacatttcagtcctatttccccctccctcctctcctcccattcaccctctttccctcccactgcaactcctatctgctccttggagagggtaagagtgcccctaggaagtccactaagtctatcccatcatctccttgaggcaggatcaaggagatcctgtgtctaggctgagcaaggtatctctccatttagaatgggctccactaaatcagtttttgctttagtgttagatcttggacccactgccagtggcctcatatattgtcccagtcgcaccgttgtcacctatattaagagtctagttcggtcttatgcaggttccccatttgtcagacctgagtcagtgatctgtcactagctcaggtcagctgattttgtgtgtttccccatcatggtcttgactcctttgttcatactatctcttttccctcactttgattgtactccaggagttcagcccaatggttagttgtagatttctgcatctgcttccatctgtttctggaatagtgttctggcttctctgggcttgtggattataggctggatatcttttgctttatgtctggtatccacttatgagagagtacatattaaatttgtctttctgggtctgggttacctcacttaggttggttttttctagtttggtctgtttgagaggctaattttaaaaaaagtgtacattagttttgtggaaagaattatcttactaatttatcagcctgttcttttcttcctgaaatatcatatgataaagttaagcgtgtgtgtgtgtgtgtgtgtgtgtgtgtgtgtgtgtgtgtattttgagacagggtctctctatgtaggcttgactggcctggaactcacagtgtagaccaagctgaccttggaagatggctgaaggggccaaaagtccatggtagcactggctgtcctggaactcactgtgtagtctaggttgacctcgaactcacagggatcctcctgcctccctagtgctgggatcaaaggcgtgcaccccccaccgcccggtgaaattggagcataatgatttatgtttctagtatctctttaattacttaggactagaagagcaaaagatgatttcatctggaaaaccaagacgtgaatcagaattttgaagggtgggagtggggatcaagtaggtatcacacagtgtgtgtttgtgtgtgttgctgaggctggaaaagaaagcattatacattgtgagccattaagtgtcttttgaactcttgtacaacgccccccccccatcatgtgaaagttcccttgttgtaattggactagcatattatttgtaattccacgagaatgaaatctgacttccatcagaggagtctgagcactgggaatttacagatttaagacttaggagtcaatttagcttttggtgagtgttttattttactaaactaattgctcttctctttaagtttaacttaacctttaaggaaatttaaatttaaaaaaaatgtttcctgcctcttatcttgtgtattctttttctttttctttctttttttttttaagattttatttattatgtgtacaacattctgcttccatgtatatctgtacaccagaacacggcaccagatctcataatggatggttgcgagccaccatgtggttgctgggaattgaacttaggacctctggaagagcagtcagtgctcttaacctctgagccatctctccagcccccaagtgtattctttttcttaataaatacactttcatctgtgtttcggtattccagattacctccgggaaaatgtatttggcctaacttttttatgtatttgttcacaagaacaatgtctgtgatttcatagtttataaaacatagacagtggtaccccttgggattatgccattttgcttggttctcacttttgtcagtacttactccttcatggcagccttgtctccaaccttgaaagctatgtgtgccggaatgaaaaatcttatttattgtgactcatttgtaaaccatcttatcttgttcctggtggaagggacaagtaggacacagtgaaaggggagcatatagttagaaattggtagaagatgaatttaaataccacttgttattccacagttctcttttgctcttattggtaactcctcttcatcttgctatacaacattttcagttagaggacaacacatggtacagaaatgcctagacaaactccctagtcctgagatttcttgtaacccctcttattttttttttttttatttactaggattttaaattcaattttgtgtgtttctgtctgaaaggcatttgtgtgggtatccacagagaccacaagaaggcattaggttctccgaggtcgaattacaggcagttgtgggatgcccagtgtgagtgctgggaaccaagcttgggccctccaggagagcagcgtgtgctcctgcctgctaagctgtctctccaagtcaaacatttactgataaatcataaataattttatttgaaaactaactctttggtacacatacaattttaccatctaccaagaatgaaaatacatttgtgtgtactttattgttttgtaaagaattaaattttggcagaatatttgatattgcaagagacagcatcatcactgtttttctgagttgattactattttgattttataattgttagtgctgagaatatgctctattctcagtatgacagaagaatgttattaagagtcatttcagaaactgtaaattttgccttaattttaatcaaaaattctttttttttttttttttttttttttttttttttttttttttnnnnnnnnnnnnnnnnnnnnnnnngctttggagcctgtcctggtactcactctgtagaccaggccttgaactcacagagatccacctgtctttgcctcctcagtgctgggattaaagttgtaaaccaccaccgtccagctcatgtttttttttagagccagagtctcattttgtagatcaggctggtttggaactctaagaagcctctgcttcccaagtgctgggattaaaagggtttttgtttgtctgttttttttctttggtttttcaagacagggtttctctgtagctttagagcctgtcctggaacttgttctgtagaccagactggcctgaaactcacagagatctgcctgcctctgcttcccgagtgctgggattaaagacatatgggattaaagttttgggtcatactgggcttgctggtttatgcttttactctcatcactcaggaggtgtaagcagctggatctctgaattccaggccagctagcattacatagtgagaccctgtctcagaaaattaaaagaaaaaaaagggagggaaaggtatggggggacttgggctgccctgtccatgttatgattttctaaaatggagtttaaaccagcaactcaagcagcagctttttaaaaaaaagacctatattttatgtgtaagaatgtttgcctgcatgtatgaatatatatatgtactgtatacctgactgatggctgtcatttgttttcttatttttggacatggtctcatataacccagggtggccttgaacttggtttgtaggaccttgagctccaggttctcctgcctctatatcccaggtattaagattgcaagactgcaggtctatatcaccaaacacatctttttttttgtttttaaatactttatttaatgtgcattggtgtaaggataccaggtcccctggaactaactggagttacagataggtgtaagctgccatgtgggtgctgggaatagaacctgtgtcctctggaagagtagccactgctcttaaccactgagccatctctccagcccccaccaaacatatcttaatcctctctttctttcttctttcagtactgggaactgagcccacagtctcctgtgtactgggcactaagctacatttccaacccctttttagtttaacttaatgttatgtatatgagtgttttgcatgcttgcatgtctatgtactgcatgtgaaccctggtgcccaaggaggttggaagatggcattggataccctgaaactggagctgcctgggtcctcgggaagaacagtgtcagtgcctcttaactgttgagtcatctctccagccccactccactcgctttgtgagacagggtcctgctatgtagcctgactgtcctgggactcactgtgtagattaggctgggctcgaactcagagttctgcctctgcgatcaaaggccttcaccaccatgcctggtttcaactccccatttttaattttcagttttgagacaggttctcacaagttgaccagagtgggctgcaactaacttggtaacccagttaggccttgaatttgtgatcctcctgccccagctagctgaattacaagtctgtatcaccaggttcagatccattatctttctataagagcagaaaactggggctggagagatggctcagaggttaagagcacctagctgttcttccaggtcctgagttcagttcccagcaaccacattgcggctcacaaccatctataatgacatctagtaccatcttctggtctgctggcaggcatgcagtcagaacactgtatacataataaataaatacatctttttttaaaaggagcaaaaaactttatatgcccagtaaaaaccatcataattcatatatacagtagtcttgactgtgagtgaagttgtttgagataatgtttattggtgtcttgtggcaagacatcttgcacattgcaaaaatgtacttgtattcagaacaaaggctacaatgaaattgtataatagagccaataacacttggattccttatgcatttgatttttaatgaatttttagttcttgcctgttgataatccttttagtgtttagttacccattttctgtgatcctccccacttctgttaagtgacttctgaaagtgttatgacttaaaacttaagtagcagagcctagagtaacaaaagttgtaattgattgctagaggaggcagagtcagttgtacagactgagtcaagagactgcacagtcagccaggcattggtgacgcacacctttaatcccagcactagggaggcagaagcaggaggatctctgtgagttcgaggccagcctggtctccagagtgagtgccaggataggctccaaagctacaccgagaaaccctgtctcgaaaaaaacaaacaaaaaaaaaaaaagagagagagagagagagagactgcacagtttcttgtacagttactcagtctgtttactgaaagtttaacaaaattatgttttctcttgaacataaatgtaattcaagcaggaataaaaaattggcatcttctgaatgtggacatggctgttaaatagacatgccttgttgaatcattaggagacgaaggccttgaaatgacatatctcttgatatgtatatgtacataagtatttatttttgtgccttttggaagagatgacaactttttcctgaaagcctttgaggaacaactgaggctctagtgtgtgtttgagagattattcaagtacaggtgaaaagtaattttaatttccttgctcttaataagtctttaatattaaagctgcattgagacttaaagtacaaatgattgtattgcttttgtaaatccaactgcatagcctttaatgccagtaaaataatgagatggtccactctcaagtgtgggaactactctgcacgccattcccctgtcccctgacctttgccttttaaccctgttgctttgtaatgagattatgggcctttaaggctgtctccagtttgctcaggtttccttgcacaacataaagttttaggcttccttgaaaagctgtttttagaattgaagaaacaacttagatttaagtgtggctatgacttttgtaaacagtttttcttttaagaagttttcttccttaatgtccaaaatatcatatttctaatagtgactttagtttgtttttgttagtgtatgacttaatatgccctctccctttatttaataaaatgttcttggaaagtttcataaaataaaattgcttatttagacagaagctaaaattgagctttctggggcacggagctcagaagaaaccctgcacagcttattcccatagttgtccctgtaggcagggggagttagcatggatcaaaaggggatcacacatgactagcaattgcttatggtcaaagaaaaccactgctttaatctttctataataagcaagttgtactttatcagttgttgaaaataaaggaagaggaaaagagataacttgttagtaatagagtgctacttgttacttgttattaataagttgcttttgggggaaagggtaaagttagtgacaaaagagtttggggccgatgcctcatgacctaagtcccgtcccctggttgaaagatgaaaggtgagaaccaactctacagagttgtcctctagcctccacaggtacctcatcatgcacacacaacaacagtaataatagtaataaaagggtttcagctcagcaggtgaagcccttgcttccaggcctaatgacctgagttcaatcccaagacctatatggtaggagggaactgaagcaaatcctgaaagttgtcctctgacctccacaagtgccttggcattgatatccctcccccatcaataaatgtaataaatagaaaattaaaaagcagtaagagtttgaggattctctgtgttttgttcttttgtatcctatcttggggttatttagaaaactgaacatgtgtttgtttcagctatttgcttccctttctttgttgttgttggagagggtctcttacatgtagcccatgctggcctcagatagctaaggagatgactgaactcctggtctgcttgcctggattacaagagtgtgccaccatgtccagtatgttccagtaattttaacagtactttctgaggagtgtctgttttaaataccacctgacagaaaatgaagctgttagacgttggttctcatggcactttcttattctgccaagagaaaagataaataaaatgattggtttgagataacaaagggcagtaagtgctttttttttatttttaaagaattgtggatttttactagtaacaggaacaacacactcaagtttaaaactaaagtgtgtacaagaatgccttcgggaaataactgccacctgttattccacagagacagaatgtgacataaaaatagaacttctcatttccggtttttaactagaagccagagtgactagtttattgttaagtaagctgggcattaatcaggaaaacctagtaagattttaaaaattattttagaagattttatacctgcatatattatatgttaagcatagtcctgctgagttccctctgtcctctccctattttgtcctgttccttactattaggcccctttgtccctcagatgatttacttctcttttctttttctttttttggccgaggggggtttggtttggtttggtttggatttttgagatatggtctctctgtgtagccctggctgttgtggaacttgctatatacctggcagacctgggactcacagagatccccctgctgttctctctagggtgtgagagttaaaggcatgtaccaccatacctggcccttccttctgttttcatgtgagataaatatattgttttatgtatctatattaaaatctaggaatgacaaatgagagaaaatacaatgtctgtcttttttaaattggcctaggtcatttaattataataatttctagttgcatcagcaaaagattttgttcaaattattactatttaatttggcatatgacatttgtaaagaactcaatatgtagttgttgactcagagaatatggagttctcggttgtttactttgggagaaatcaaaaccttggcacttgcgacacattttttttttcctgttagaattcctccataccatcagtaattaaaatacagggggaaaaggaagaacaactttgagtctcaggagtttaatactaaaataatctactctttagtttttttttttttttctgtaatggaaaggagaaaggaaaacactaatgataaattaaatgggaagacagaaaagcttactaagcagaatgtagtaatattttgtttgtaatttaacaaataaagcttgcctgaatatcaaagtgcagagctaagctactagttagccatagaggtcaggcagtggtggccacacctttaatcccagcactcaggagacagaggcagggccaccctgggctacatgagagtgaatcagtctaaaaaagaaatggagctcatacctgtgatctcagcgctagagaggaatataaggcaggatctcagtgcagtctcattgtagtctgaggtttggtggagaacattgcagtctgtagtcacaacaaggacaggatcggcccccaacccccccattagagatgactgagccttggtagaggtgagaactctccagtggttggctgctttgcttttctgatcttcagcttgaaccccaatatctgtctctggctttttattatttgtgctacagcagaagaggcaattaagtgtgaagatttatttgttgtcacacaacacaaccataatgtatttaaatgttataagaaacttctgaggaatgcttgactgtctcctgtcttacaggttgcttttagacaatggttagggaggctggatcatctggcaactgctgcaaatctgtcatagcttcatcctaactcacaagatgggattatataaacattcacaatcagtgttgggcactaactctagaatgaagagaatgtctgcagtttccctttacgtgtagcaggaataagatcagagacgatgttttgccttttttttttttggctgttggtgattttaaaattctcagatcatattgttataaggaagttctgatttttgatcccttctgtgatatgagtttcagatgaaaaaaaagcaaaacaaagccatacaattttgtatgctaacctagaaatttaatttaaagacattcagaactaatctagagtttacaaaggttcatttgtcatacgtagtaaacttaagcaaaggtagatgtttatcattttccataaacctgtcagttcagtttactgaaaattaatggaatttaaaaaatacttaatctgtttaatgagtgtgggtattttgcctgcatgtgtgtctgcataccacttgcatgcctgaaccctggaactggagttagagatgactgtgacctgccatgtgtgtgcggagactccagcctggatcctctggaagagtagccaatgcgcacaaccactgagccatctctccagctctggaggacttttttgaaggcagggacctactttgtagccctggttagcctggaactcattatgtagacctgactattctcaaactcatagagatttgcctgcctctgccttcagagtgcaaggattcagtatgtacaccatcacacctggttctgaatatgatttgaattagtgtagcaatgcctactagggtttgtcagtttacttatttattttgagtaaatgaagcagaactcctggaattaaaaagtacattaataacgagggggatgcacaaactgacttagtggagcccattctatatggagagatactctgcccagcctagacacaagggtgggctggagaggggccttggtcctgcctcaaccagatggtggcacagacttagtagacttcctaggggaggcctcaccctctccaaggagtagatgggatgtggtggggaattgggaagagggagaagagggggggggaactgggattggaatttaaataataataataaaaaaagaaaacatttaaaagcaaaaaaaaaaaacccaaccacaagccacaccaaacaaacaaacaaacaaacaaaaaaagaacaaaggggagctggacataaataatctcaggccttggcgggtttgaggtaggaagctcaagaggtcaaaaccagctctatcacataatgattttggagccagactgcttatgtgagacactgtctcagaagaaataaattggagagagaggggaagggaaagagaaaatgaacaaacacagagtggttagcttctaattagagaggtaatatttgcattttttttttttctgagagtaactccacatgagagattttgggtttcagctgatatagacacagtggtttgtgtaaggaaggaacacaaataagttagtttcagatggtgcatattgaagtcaattttggttttgcgatagtgacgctggtagtaataacagacaccttttaagttttttttcccctcttttaatatttttcctcccttcgtaacagtgagaattagggtcattttctccacatttgtcttgatagtattggtagacctagaatttgattttttaagatgtatttatttattttatgtgcacatgtggttttgcctgcatgtatgtatatgtaccatgtttgtgttgtgtttggtgcccaaggaggctagaaaagagcactgggccccctggatctggggttacagatggttgttaaaatgtcacatgggtgctgagaacggaacatgatgtttcacaagagcatccattcagtgctcttaatactgagtcatctctccagaccctagagttttattttaattaaaaacttgtttgttttttgagacagtcttactgtgtagccctggctggcctgaaactcaatgtagaccagtctggccttgaactcacagaaacgtgctttcatctgcttccctagcacttagattaaagacaagcaccaccaggcctggtgaaaatttgattttaaagttcagacccagataatttctagtggtttttcccttttgtcacacctacctatatgcattttaaatttttctttcctcttctcttttccttccttttttgttaaggaaacacagaatatatacatactcatttatgtctgctttgaagatggagcataaagataacatacttaaattatgttagtacaggctgagacttactttttgagttaaagaaaagcatattaattattaattagtaaatatttgtctgttttgttttgcaaagcttcagtttgcagttagagtgcacagctgtttttatggcagaccttaaaatagtttgttgtttggaatacatctgtgttctgggtccataagtcagggaaccatatgatttttaatggtgagtttatataacatacccgtctataactagttcaaacagtgtcagatgcttgcactgacatttctaatgcctagatctcgggaactactctaggaaaatgtctaccagttatctgagtggaagaatttgattaaatacttgctgttggttggtaatgcaggaatagtgtttagtatggagttgagtgggatataattcctcataaaaagctatatgttcttggaactcttgtgtagacatccagaagtaagttcctaaggttgtgaccactttactgacagcttttgtgtgtgtgtgtgtgtgtgtgtgtgtgtgtgtgtgtgtgcagtgtgattgtgttcaagtgttgaagtcaaaggataactttctggagtcagtcctttctttctaccatataagtgagggattgaactctggctgttttactaggcagcccaggcatgatgaaatatgaccataatcaaagcactcagaagacgaaggctgtaggattttgagttctaggctagcctgggctactcggtaacttcaaagcaaaacaaatctcatatctgcctctggccatttacttatttccttcagaagtagttaatcacatttttgtttattgtttatattgccatgggtatttttttttccagacagggtttctcaatatagctttggagcctatctggcacttgctctgtcgaccaggctggcctcgaactcacagagatccgcctgcctctgcctcccgagtgctgggattaaaggtgtgcgccacaaacaccccgcctgccatgagtatttttatatactgtgacatattattaatcttaaatgtatctccctagccaaaactcaaaagttttgttttcagaaagagttttttcattttttgtttctttcttcttttttttttttttttttttttttttttttttttcaaggcagggtttctcggtaggtttggagactgtactggaactctctttgaagaccaggctggcctcgaactcacagagatccgcctgcctctgtctcccgaatgctgggattacaggtgtgcaccaccactgcccggctcagaaagagtttttatttctaaaatctctcacaaacttttagtgaatggctataataacctccacatttttactaggttttctgtggcccgtagggtctggccatcagcagactagggcagagaggtacactagggtagctctgccttgctgctggtgctggtgacaacttgcttcagtttatttcatctacagtgatcttgtcctccaggtcccagatcttgatactggagcctgtggcaggacagagccagtagcagttgagtctaaaagcacaaggcaacagcgtatgtagcctggcctcctcccctccaaaagcacagaaggatctgtctggacagaccatgtgaacttttttttaaagtaagtctcatacggcccaggagcagtcaaggagccttagttttatgcagtactggctggtggatctgagtctttgtgcaatgctaggcagtttatctaccagcttcgatagtccccagccctgtttttaaggcttctagagttaggttaattatgtagatgttgagaaaccaaccagttactgaaagtggattattccgttttttttttaaaatctagaaatcagctgggtggtggtggcgcacgcctttagtcccagcacttgggaggcagaggcaggtggatctctgtgagtttgagaccagcctggtctacaagagctagttccaggacaggctcaaaaataaaataaaataaacacaaaacaaacaaacaaacaaacaaacaaaaactactcaataaaatctagaaatcttaggatgttctttcttttaacatctgtactataaataaacttgccatctggatgcactggtgtatgcctgtcattgaagtactctgaggatgacggatccctctgagttcacagccagcctgggtcacagagtaagacattctctgaaaagaaaaaaaaaggcaaaacaaaaacaaaaaacaaaaaacaaaaaacccttaaacttgtcagtagggctgctttcttttattagcttattaccttgtcagattactccagaatttaacactctccaatgtatgctgtagatagatatagttgagtggtacaacgtgtgcctagcatgaatgaagtgtggggttcattcctgagcgtcagaccagcccacctgcaaaatcttttctgtttccccttcccaggggacccctgcatccccccacttgacctagttaggcttctcatgtccacttttgcttctgtaaagacatctggagtctcaagttctaaaaagcaattaggcgtgaggtttttgtttgattttatagtttatgatgatcttgaaagaaaagtgatggtagttttggtctttaaaaataaaaaggagaaagattaggatagtgtgcagggggagggggagacactggaaagtgcttgatgaattatgtaaggaaagcatttggctttggtcagaagtttagttgcagtcggctgcaagtgaacccatctggcatactttttcattattctcctgaaatattcatgggctcccacagtccctgccttgtttccattggattcatacacactctcatcttcccaagactgctgtgggtttgcagtaggttgtcctcgttttgtttccatgttgttttggatataatcnnnnnnnnnnnnnnnnnaggaaaagtttagatgcctatgggcgtggaacaaagtaaactacatgtattttgagaatgggaaacaatgaccaaagtaatcaccatagtttattatactttaaggtatgtgtaatacttagatatctctagatgaatctcttctgaccattaaatagcactccttttcactggtagtccctagcactacaagaaaagaatatataaataataataaatctggcccttagtgagtaaatctgtggtttaaaaaatacatactttttatctgtggacaattagccatttatatttgtcacttaggcttctggcaataaggaagtagggctgtccaggtgtattaatttatttcttttcttttccttttttttttttttttttttttttttttttttaaaaggggttttttttttttttttttggtttttcaagacagggtttctctgtggctttggaagctgtcctagaactagctcttgtagatcaggcaggttttgaactcagagatccgcctgactctgcctcccgagttctaggactaaaggtgtgtttcatcaccgcctggcaatttatttctaaatacttttaaaatattttatttatgtgtctctgtgtgggtatatgtacataggtgcaagcattcacagaggtcagaagtgggtgtcagatcctctggaactgaagttacaaataattcagagccaaactcagatcctctggaaaagtaatacaggatcttaaccactgagccatctcttcagccctctgtgtttctaccttctaaacctgaaaccatctaaaataaacagtttagcataatagttgtaaacttgggttctgggtttggcatggtcaaaatagatctgagaaccaagtcttgtagtggagtggaattttctacttcaggtcatgcttatactgatacagggaaagcatcaggcaacctagagaccaagcataaggtctgtgactatggactcacctttacctaaaagtggaatacagacaatactcttgggacagaagtctcttgggagaataagttggcggaagggttaaaactgactcttgataccatatttgtaccaaatacaggaaagaagagcgggaaattaaaggcctcatttagacgggattgttttagtctcggcagtaatgttgatatagatttttctggaccgaccatctatggctgggctgtgttggcctttgaaggttggcttgctggctgtcagaagagttttgacacagccaaatccaaactgtctcagaataattttgctcttggttacaaggctgaagacttccaactgcatactcatgtgaatgacggtactggatttggagactcaatctaccaaaaagttaatgagaagactgaaacatcaataaacctggcatggacagctggcagcagcaacactctgttttggcatcgatgctaaatataagctggattgtaaaacttcgctctctgccaaagtaaacaatgccagtttaattggacggggttatatactcctctgaccaggagtcaaattgaccctgtcagctttaatagatggaaagaacttcaatgcaggaggtcacaaggttggattgggatttgaactggaagcttaatgtgcttttgagaagaacatcatttgcccctggaagtgaagaaaaatgaacccactgtgttttggccttaaaattctgtgaaatttcaaacgtgtgaacttttattcttccaaagaattgtaatccttcccacactgaagtctagagattgcaaatccatcctaagagaggtccttgaaggtatgcctgcagattgtcatgtttgtgccacatttcagttgagttctgcagtgttagtttaaacatgttcctcagtaacaaggtagtgccatattaaggaaaatgatctgacaccccggtttgaacatcacgtcctgcatgtcacactccacttttccatgaccttttgttatatcagtttctgctgtagtgaaatctttggttttgcatcagagtgaaataaacccgtcacatttgtaacataaacaacaacaaaaaagaccctttcggttgtaaacttgagggaaacttggccctgatataggtgccagttttctcttcttaatctaggagtagctgcaggtggaactggtaatggatttggcactttgtaaatctgtattgaatcaacagacttcctgggcattgaaccttgatttcctgactcagaactgctaaaaactgtggcttgatgatgtagacagacccatatggaaaagacttttaaaaatagcttttcatgccttattcccaccccagccatctttacctgtttacaccaaagtagcctatggggtgtgatagctacttcttttgtcattgtcatgtcgtttggggtagagaggatggatctgaggaagccagtaattcaagtcttaattcctcttgttatttgtaggtttcttgttatttcactgcaccaaagtatgaaatagctttctggaactccggacatgagcaaggcagagtttttgtcattgtgtcacctggtaacaacattagagatgtaaactggacttctgttgcatttgtcagcactgtttattttttaatagtctcataggtacattttagagttcctgttttgtgtggaattacatcttttccttcaaacgctgttatcaacatcacgtaaaaaaacttgaataaaatattgagacctaaaaagatgagatcagtagaggaaaaaacatgaggttgctatctgacctccacatacatacacctgtgcatacagctaatacacacacacacacacacacacacacacacacacacacacagacacacactcacacacagagcacagaatatttgcatgaaattggatactaatttttacaaataaattatttctacagtaaatccccaagtagtatgtgaaaaagattggacagaaaaaaaaaagcttattcaaaatagttaattttgttatagttgtttttttgttttagttatcctatgtagccttggctgtcctggaactagctctgtagaccaggctggtctcgaactcacagagatccacctgcctctgcctcccgagtgctgggactaaaggtgtgtaccaccaccactggctattcccttatctttatagagtgtgcaaaggtccacaagtcatggtgtgtaagtgtaagtcagaggacagcttgtgcaagtctgttctagtcttccatggttttttcatggagtatcttgttttctccatctataatgattgaaagctttgctgggtatagtaatctgggttggcatctttggtcccttagtattaatagaatatatatccaggtccttctggtttttagaatttccacggagtggtgaggtgtaattctgatagggatgccttcacatgttacttagcccttttctttgctgctcttaatattctttctttattctgtatgttttttgtttttatttttatgtggtgggcctagccagccagcaggacgtaagtagaaaatgggggttcacatgtgtgtccctcactcttaaaccttcctcacttcaccctgaccacccccaattggtcatggccaggcacatatgtaaccagcccctaggcaggcatggttagggtgtcccctacaattccccttttagtctaaagaggattaaaacttaacagtgttaaatatccataattaaaaatcacgaggataaaatacaggaagatataataatctgcttatgccacatcctaactatgtctattctatttcaactaaaccttaaagtcatgtgaaagtggtatccaagcctgaacacctcctttctataccaaccataaacaataggaaactagccctaactacgtgtacagcaccagatcttgtaacatatggttgtgagccaccatgtggttgctgggaattgaactcaggacctctggaagagcagtcggtgctcttaatctctgagccatctctccagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtgtcatattgggttttctgttgttgaatgtgcttttaccttgtcctcttctcatcctttcttctagtggatgtagcaagtgttttttgttatcctggtgggtgtgggaccaaggttcccttctgatgtcggtcctcttctcgtagatggaggtgtcactgtttcccgggtgtcagcagtgccgggtcccgctgaggtagttggaggcagagctgtcacccggcctcagggtgtcggatcccgctgccgaactctgtctggcatgcgggtcgcttgcctcagatgactctgagcagcgacaatgaacaggagccggaaacagcccctggcctccctgggccagtggatggaagccaggctacctctgggtgttcagtgttcggaacccaccgctgccgaacacggtccggcacttgcctcagatcactctccttttacagaatcttaatggcctagaagttactaatgatggatattaaggtaatagcattgaaagattgacttattttattctcattcaaaatgtgtcataaagagctgggcgttggtggcacacgcctttattaatcccagcacttgggaggcagccacaggcgggatctgtgtgagttcgagaccagcctggtctacaagagctagttccaggacagcctccaaagccacagagaaaccctgtcttgaaaaacaaaaaacaaaaacaaaacaaaacaaaaaatatgtcataaagtgattgtaatatactggcagttacaggctgaactcagcatgtgagtaaggggaacaaaacctcacaaaatacttgataatttgattttgaggaattttgttgtcaacagagggtttggggtcttttttgttttgtttgttttttgaaatagggtcttgccatggatcccagactggcctcagaaacatcacccttctgcctcagcctcctaggtgtaatacttgtgtggttctttaacatactttgtagacagagttgcttgtgttcatctactttggatcttatggagtttgtcttctgtgtctggtgcttcagagtcatcccatagaaaagctgtactgtttgaactgaaggatggccagtaaagcgtgcagtgtttttaacttcagacagtagctcggtagttatgcatgtagatttattactatttctttcccttgtgctaccttcagaagttagtaacacgtcctgaccagtcccctgtattcagaaagaagcacaatacatttggtgtatctattttctcctactaaccttctgacacgggtttaatgctgattagtccccaaagaattctagatccaggctccatggcaggataaagaataatcgttggtttgcacacgggccagacgcaggtgttgagtccagaatatgtcacatgaagatcatattttgtttaccaagatgaggttaaattagcatagcatgaactggagagaagaaagggtagagtgaggtagagaggagcaggctataccagtcagttaggatgccaaagtatctaatggcattgaaaggttgactgaataccttattcaggtgagctttaagtcactttgcattgggaagataatatatagtcctaaaggctcaattaaaagtcacatgaaagatgtgcttgctaataattatggtaaaaatgatgtttgaataatacttcgaaactcagagatgccattttagatactcctcttgtatgtgcctctcactcagttctgggtctgacataggtgtaaggtgggcatttaatggagtagaactctgtctttgggtttctggaagtttcatccaaaccatacttgaagacccaggctcctaactcctacacacaaggctgagttgagggatgggaaccctgtttggattttcttagtttttgagtgaagttgtgtttagaggatcaaattgtcctattttgcatttaatggtcacatgtttcaaagctcctcttgactatggtattttctcaggctttgttgtctctggtagtttttttaggctgcttaccagatatatgagcccttttggaatgtgatattttgctcatgagagtagagttctggggttgtgtgtcaaaagcatgtttgatcttactaaactgtctttcacactgtcagttctgagagttcttggcatttggcatccttagcattttgggatactaactttagggccacacccattccagttggtcaggatacaattcttacaagtcatttagttttatcatcattttgtttcctttgtctgagtattcctcttgaaattagtcttaagatgtatgtgctttccctctatacttgtaagtgttgcagatgtctaagtagtagttattatgttaaaatcacttatgttctttgcttgtaaactacatgtcactgaagttaagctgtgggtctgacctgaatgtttcaaatttaattgcttttgtttaattttttgtcttcattttccattcctcagtatcatttttgttttttgtttgtttttgctttgttcataaagatttttgtttctattacattatgtagttttgtaccaatggctagaagcagatcgtcatggcaagagccaagatactgcaaatacgacttcaggtaaaatagtttaaaaatgaatggggtattagaaatcacaattttaattcaccccacgtcccattgtgaatgcttcttaaatttgcttagacaaaattataggtgatagttgttttttgttctctcatctgcatcttaattttcataaagacctcactttgctttaagccttgaaaaaaatatatttactagtctaagctgtcttggcatgtatttcctatttccttaggaggaaaggcttagttaaagtttaaatttagtagatcatttggcaatattgtttgaaattagtcctgtatatagtttataagagacaatattaacattgtagctatcttttggcaatggtaaaaaatttaacataggttccttacaagtatataaatacttgaagaaatttgcattccttatttatttcaagactatattaaaaaggtaaattttaatttaaggatgtttatatacagtttctatttcatttgaatccaaaatctcaagcccagtcattttttcctatgaacttttttcttctcccactgatgttagtaagactagaataactacatttattcattcctgaatccttaccagtgatatcagactctttccctaatttctttcaaaataatatttgccaagacagctgtacatatagcagtgatctttcttgttgctcttctttctttctttcttttttcttttttaacagtataagagaaattggtgctggtgctgctagtagctgtggtggtgatagttacgggtggtggaggtgttaataaacggtgcaagtatcggtggcagtggtggtggcggtggtggtggtggtgaaaggaggagaaggaagaggagggggagaatacgtgtgactgtttatgtgctttgtatttttttttttaattctttatggggcataaattggttgtgacttcagattgttggtggttccacaggcaacagaacaattatattaaaaataaaactgttggccaggtgtggtggcgcacgcctttaatcccagcacttgggaggcagaggcaggcggatctctgcgtttgaggccagcctggtctatgagagccagagctgttacagacaggaaccctgtctcgaacaagaaaaaaaagaaagaaactgttatgacttctcctatttatcttctgtcccatttataacttgatatctgaatgaagatgttactattttaaccatgcacaggcaggaattcattaaaaggtaagtattacaagtagttatatcatgggttatattctgtttctgtttttttggttcttgtggtattttcttacagttatggataaaaataggcatttcagggtcttagattgtgggccaaagagagggtttctatagctttgcattatctcatgataaactttttgctgtgacaatagctgtcagtaacataggggtttttgtttgtttgtttgttttttgaaacagggtctctctatttagccctggctatcctcaagctggttctgtagaccaggttggccttgaggtcacagagatccacctgcctctgccttcccagtgctgggattaaaggtgggcactagcttgctcagctgagtagtatagatttttagaccagaggacctttttcctggctacctatttatttatagaccaaaagtgaagtgaaaactagtctttttcaaaccaagaaaatataaaatatcttgatgttcacaaacaaacaactagtacagcttaagaacatcatttatccagaagtcaacaattttgaatcctgaattctgtgttcctcagtcgtactgactcatggttaacatttatctcctcaacctttagtcattaggcaatctaggagcaaggtttaaaaattggtgaatttactaagaaagcatttatttatttaaaaatttatttaatatgtataccgtgttctgcctgcatatatgtctataggctagaagagggcaacagatctcatcacagatggttgtgagccaccatgtggttcctgggaattgaactcaggtcctctggaaaagcagacagtacttttaactgctgagacatccctccagctcccagagagcatttatttatttgtctgtctatttattgagaaagaactcaactgtagcccaggctggcctggaattcactatgtagcccaagttggcctagtattcacagtgatcttcatgcctctgcctctcaacggctggaattatagacatgagaaaccacatctagttttggggtgcctttgacagtttctctcctggaagtagaagctctcaactcttagactgtgatgtattatttatgacttattaaagcttgactgaagatttagacaagcaaagtcagcctgaagttgtagagatcaggcagtggtaatgcacacctttaatcccatcaggcagaagctaggaggttgtggtacacacctttaatcctgggagctggtacatggagcagccctttcaacctgaaatttgaacccctgtatcagtctctgggtcatttatttttgtgttacactacatacatacataatacttgactaataaaaaaaaaaaagagactccaaaggaaaatgaccatttgttaaggacttcagttagaagccgtagtttagttgttttcagcaaatacatttaaattatgtgctttattcataaaagttcctgtatatttaacattgtcgtttccaataagatatcagtgtataacatttcccttgtgtgattttttttttttttttactcacacaactcaaagctgttttagtatcttatcttttcatatttttatcccaagtggacactgagtcatgtctagcaaggtatcagtgccacttctaagtccgattgatttgtgattctttaattgtacaaatactagtaaattacatttatatctttccataactgtagtttgtacttaattagaactaaaaagtagaaggcatccattctttaatcccagcattcaggaggcaaagataggtgaatctctatgagctccaggacagccagaactgataatagtctcaaaaggaccaaagaaaagaaaaggaaagaaaagaaaagaaaacaacagggaataatgaaattcctttgaggtcttctaattcctgaatactaacttttttacattgactgtttaagatccatctaaatcaagctattttatgaaactaagctatttggggtaatagtcttatggaaattaatttggtcaaggaaataaacaaatctgattaccctatgatttttttcatgggggatggtggttcgagacagggtttctctatgtagccttggcaatccaggaacttactctgtagaccaggctggccttgaactcagagattcatctgcctctgcctctcaggtactggaattaaaggtgtgtgccacctctgtctacagttacctttctagaaatttgataggtgttgacttgggtatagaatacttatttctttaaaaggttaacgtgtttagtgtattttacccattgtttctgattttgttgattcaatcactgaaaacctgtctgtcagacacttttgtggcaacttaaacaaaattgcatgcctgcactgcagcattgggtttgtgggaaaatttcagtatcataaccttcagcttaaatcaaggtgtttcttcggtgaaacgtttctatataacttatcactgtatgttgaaatgagtataataattacatgcaccaatgatatttgtgtattttgacttttagtgttaaatacagctgtgattttaaaattcagattctaatgtttttaagtacagacttctttctttttttttttgactgtttttcttttctttttctttctttctttttttccttttagttttttgagacagggtttctctgtgtagctttggagcctgtcctggaactcactctgtagaccaggttggcctcaaattcacagagagccacctgcctctgcctcctgactgcagactttttaattgatagttctccagttggtaagtatttttcaaataagtttgagaaatataatcagtaaatgtttttttaagatatacctgtatattatccaggtgtggtgccatacacctttgatcccagcactcaggaggcagaggcaggcagatttctgagtttgaggacagtctggtctatagagcaagttccaggaccgtcagagctacacagagaaattctgtcttgaaaataataatagttatatagagtagatatttttaattattatatctttttcaattccaggtattcattgattattaattatttgttgtaggtgaaaattttgaccagagtcctttgagaagaacgttcaaatctaaagttctggcacactaccctcagaacatagaactcaacccttttgatcaagatgcagtgaacatggtatatatttttccttttctgtcctgtttcttcagcatttcttttattaggatataaatgataaatgtctattatttaatacaactaatcctttaaattctatgagaaatagtatttttaaggtttcattttttaaatgtctgtatccatcttttgtatgatacatgtgtatgagtgcctacagaagccagaacagggcatcagtgttattgttttgtttaaaaagaagaaaagaggaattgctgagaaagacatattgactataagtttattataagggccggcagaatggggagactaagaagaggaacagagtaatggctgaccgccctggccgggcgccatagagagacagagcggggaaacagagagacgggagagcacacacagagagagagagacgggggagagagagagagcgtaaaggggaaggggcctatcttttaaaggggtcctctgcatggaaccttgggctgaccagggtattgcctgagtggattccaccaggtaacaggggcaggccagcataatgcctgaacctttcattcccacctctacttattattaaaaaaaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaacagacattgccaaccaagaagaaacagtcataaatagaacaaacagaacaatgagggacattcccaggtgaaagaaagttcccattgggaggcagaactccgctaatttacctattcactgccagtaacctcactgccagtaaccgaaagatcccgtaaaaatgtatttcccgtgggcaaggccaaaaaatgtacagattgccctgtctgagagcacccggcccgaaaccgaaaaatggacccagagtgaacagttctgggtctgccccataggaacgttttttggtatcttaccggattgtagcgaataggcagatcagtgagttccagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgggggggggagggagagagagagagagagagagagagagagtgagtaaaggggggggggcgtatcttttaaaggggtcctctgcacctgcgtgcagacttctttcccatggaaccttgggctgaccagggtattgcctgagtggattccaccaggtaacaggggcaggccagcataatgcctgaacctttcaatcagatcccctgcacctggagttggaaggtcaattcgggtcttctggaagaatagtctcttaaactcaaagccatctctccacacatccctggaaacacaatattgtctatttttacagatggggaaactgagtcttggagaagatagtttctcagattttccacagcaattatcacatcgtattacttgttagtaatatacaacagaacctcaagtccattttatttcctactgttaatctgtgtttgggtttgtattaatacatgatacttggtaaacagtggagctttctgttccagctggtcccacggcttttgagcccccaaataaacacaaagacgctattttagttgtaaatctgttggccaatggctagggcttcttattggctagctccgtcttaattattaactcatttctattactctacatatttccacatggtcttggcttaccggagaatgcctggacctgttactcctttggcagcctacgtggtgactgttctggcaggctttctctgcctacctctcccagaatcttcctctctcttagtcccgcctgtcttccttccttattggccaatagtgttttattcatcaaccaataagagaaacatgtatacagaaggacaactcccatcagtggtaaaccacttctgtttgcttgagggaaggaacatgatgtatttccatatatcaatgagtagtgtataattggtttgtattttgtcatttttcagacatcatgaagatggaaaggaactctaaaactattttatctatcttatgtatgtatgtatgtatgtatgtatgtatgtatgtatgtatgtatgtatatggactcagcccttccacagcatgcatatggagatcacaggacaagttttctctttctgccgtgtatgtcctggtgatcaaactcagttggtcaggtttggtcataagtatcttttcacccactgagctatcttaccaacatgtttttctttaatagacaggatttcactctagccagactggccttgcccttttggctgtctttctacaccagcctctcatgtgctatggatccaccacacctagactgtagaggagcttaaataggctatttaaacgtcgctaggaattgtttatgaagcatttgaatccaggcaatacgtcacccaggagtgattataaatttctttggttgcccgttggtggtggcgcacgcctttaatcccaacactcaggaggcagaggcaggcagatctctgtgagttcgaggccagcctggtctccagagcgagtgccaggataggctccaaagctacacagagaaaccttgtctcaaaaaaccagaaaagaaaaaagatttatttatttaatgtgtgagtggtctattatctgcatgtatgcctttgtggtaaaagaaggcatcagatcccactagagatggttgtgagtcaccatgtggtcatgtagttgttaggacttgaactcaggacctctggaagagtagccagtgcttttaacttctgtgccatcttgaataagaatgaccaggctcacctcgaactcagagaaattcacctgcttctgcctctcaagtgctgagatcaaagacatgcaccaccaccacccagctcctttttttaatagttccaaatttatttagaatgtgagtttacttaacattaacaattacattttgttatgagtgctcttacgttcttaatttttaattggaaataaattcttctcccatgtaatacatccaaccacagtttcccctccctccctccactactcctggtttcccttcccctctccatttcccttcagtaaagggcagtcctccatgagacaacatccaaacatggcaaaataagacaaagcaaaaacttcatatcgaggctggacaaggcaactcaatagaaggaaaagagtccaagagcaggcaaaagagttcgacacacccactcacactgttagtctcattttaagggctagagatggcatagcagttaagagcacttgaactatcttaccttcttccgtatacattcaggtgtctgcttctctgggttcctatacatctatcttggtccaggaccatcaggagctcttactttcctttattaatcactgtctgatcagcttctcctgtctattctgttcttcctctaccttctgcttattctgctacttctcttggcttgagtctctttcccacaatgaattattttttaatagtttatttttattttatatgcattggtgatttgcctgcatgtatgtatggctgtgtgagggtctcaggtgccctggaactggggttacagacagttgtgagctgctatgtaggtactgggaaatgaacccagttcctctggaatagcagtcagtggtcttaactgatgagccatctctccaggccccggtgaattatatttacttattatttattttttggtttttcgagacagggtttctctgtggtttttggaggttgtcctggaactagctcttgtagaccaggctgttctcgaactcacagagattggcctgcctctgcctccctagtgctgggattaaaggcttggcctcactcaaaacctggtggcactttgaattatttttttaaatggatttattttagggtcagtgagatagctcagcagatgaaggcatttccctccaaacctactaacttcagttcaacccccagaacccgcactgtagaaggatagagtcaattcccaaaagttatcccctgatctctacacacacaccatagcatcggtgtgtccacgacatgtacatacatacatgttttaaaattatttattaatgttcatatttgtatgggtatgtcagtgccagtgcctgtgtagaccagagatacaggatcctctggaacttgagttacaggcaattgtgagcttcttgatatgggtactgggaactgaactctggtccgctgcagaaacagtattaatgacttaatgagtaagctgtttctccagcacccatggtaaattcttattgattcttaagatttcattttaaatagaatgttcatagagaaaatgtcactttccacttggtcactcatggaagcattgtccagtatttggttgtaagacacatcttattttcagttgtcttttgttagttgaagaggatgttgttagtaagtattgtgggttagcaagagacttagagccatggtgagcaaattatgatttatgtctcaggtttcctgagagacttaatgtctttgttcctggtaatttatacaattctgactttgaaaaagtcatcatgttttccaattcagagttcccagaatttagaatacaaattttgcctttttaatttgtggaaaagagtttaagaaaaattcttacatctgttatctatggaagtctttcttcacttgaatataacttttggcaagcttttcctgtaaatgtttgaatgtgtgctcaagaaagctacaaacccttaactgaactgagtatttggccacttttcaaaaacattgtgagctttttggttctctggtttagatggtaagaaagcctgtcaataaaattaagtcttagtctgcctagtgacataatcttagcacttggaagacagaggcagtaggctcaggaattcagcttcattcttggctgtctacatagagagttcatgaccagagtggaatatatgagaccctatcaacaaaacaaaaacaaaaaacaacaataaaatcagcaaaaagcatgaaatcaaaaaaacttaaatttgactttctgcatgtcactacatttccatattgtctacctgatataaaaagagaagccttggggagctaaagacatgtcccagcacttaagagcacttgctgctcttgccgaagacccgggtttagttcccagcaaacacgtagcagctcacaactgtctgtaactccagttccagggaacctggcactctcttcaggctttcctgggtaccaggcgggtgcgtggtgtacatccacacatagaagcaaaacatttgtgcacatacaataaaaataattcctttttaaaaaatgtagagagccagacatggtagcaggcctttagttctagcacttggggcggtagaaacaggaggattagaaagtcaagaccatcttcggccacgcaacaagcctgatcacatagattatgttttaaagacagtaaataaataaataagcaagataattggcccagaaatctgtgatttgagtaggcttaacagattctacttcatggtgcattagaatggtttacagactaaagagggatatcagctgaagactggtactcacaggtccattttcctatgtgaggctatagctaggacatgtgtcattgtgctgtctcttcatctggatcttgccatgtagcatgacagcttcaagtcagccatttttccttttcctttcctgtttaatcaatgaaaaacatttattcagtttcaaattaaaattataaaaacctatcatcttagcttatttagaaaatggaagacacatgcctaaatttttcaaaaggaataaaaattttacctcctctcaaccctttatgaggatattaacaatctttttagtttttaaccccaagtttcaagaacacttacaaaaaaaattgttttggtgatgtctcaacaaaaaagcctctttttgtatatagtgtcaataagctgactagtacagaaaattatatatactgtatttttagcaatgggcaggctgctaccgtatcttggtagagctcaagtggtgctggggaaaaggagtttgctttctttccatggctgtgtgcatgaaacaagcaggaagatatgaagttactccagcttgtatcagctgtgctttcagacagctgaagatcatgtaatgagtcttgaagatttggagtatttgagctcagtgaagggtttgtgtttcccagttgggaactcccgtttgctgggctcccattatccttcaaaatacagaaattttttttttttttttttttttggtttttcgagacagggtttctctgtgtagctttggagcctatcctggcactgccctggagaccaggctggccttgaactcacagagatccgcctgcctctgcctcccaagtgctgggattaaaggcctacgccaccaacgcctggccagaatacagtatatttctagttgtccatgtagttagctttccataaccttacacagcagtcatctgaagatgccagtactgttcctgttgtgttacaacttacccgccagacctgagaattatgggtaccccactgagccacagcacagattcagattttgttgaatccccagaagtaagttctttcctcacaagttttaatgtgaaaattcttaggtctttggctgttattgccaggatgtagaaagatcttcccaaatttggagcaaatgcaatatcatgaacaggatccagtgaccatcataagagtttcagctttgcattattcatggtattttcactgtaataaaaaccttgagctgggcggtggtggtgctggcttgtaatcctggcacttgggagacagaggcaggtggatctcttcgaggccagcctggtctacaaggcgagtgccagagctgttacacagagaaaccctgtctcggaaaaaacaaacaaacaaacaaacaaacaaacaaaaaaaccaaaaatcaaaaacagaatcctccgaacctcggccattgcatggagtagactcctcttattacttctcacagctatagtggaagagtgagtgagggcaagagctggaggtgctccaagaaatacagctacagctcagcttacatgaggtctcactctgcagagacccctgggagagagcagacatctggtgcctcacatattcttactataccatctgctgagcaggttgctaacatgagacccatatgcacagagcaaatttcacattcgtgatgggtgctctgctgtctcctggagttacccctttacccattgactttgtcctggaaggtcatcgtttgattctcccgtttcttcccatactgaagctgtccagtcaaaagaacaggaagcctaagcctgtccacattcaggacaagcctgcatcccgcagatccactgtgtgtcttccagccagcggtgtaatgccagtctccattttcacttctgtctcctgagatggggaccgcctctccctgagggcactggcatttgttcagtactgttaaaccttgacggtctggtctgttgctggagcaaatggccgtctggcacttgtggaagacaaaagacacatcatagatgatgtccctgtggtccactgtgatgccacctgtcacaaaatagccagcgccaccagttttctttatttgttgcttcaagacttccaagatgtgtgaccagtgagaggtggagctgcctttttttttgtctttgacagctatgtcattatgtgtcatttgttactgctgttgaatttcattataggggtgatctacatttccccctgtacaaatccatctaactttttcttctttttaatataataaaaaattttaactgcttattcttattcagtcatgttagaacacagccatcccaagcctatatgtgtttcacactgtagggtagagttgaatcacattcagatagttatctgactctgtaagaagtttgctactctgtggtataggcattctgagcagcctggctgtattcaggagaggggtagactcgacttcttcttcttcttcttcttcttcttcttcttcttcttcttcttttaaagattttatttatttattatgtatacaacattctgcttccatgtatatctgcacaccagaagagggcatcagatctcataatggatggttgtgagccaccatgtggttgccgggaattgaacttaggtcctctggaagagcagccggtgctcttaacctctgagccatctctccagccctataatttaaaatatcttgttatatacccttctattttagtaaataaaaaggtttcatttttaaagtttatttttctaggatcaagcatgattgttcaaaatagcaaaagtgatgtcagcatctgcagggtccatcattttttcagagatttctactcacaaaaacctaggatccttgcgaaactgggcaccctgcacgtgggtgtcagttaggaggtctgggcagtctatggcacctctggcagtgtatcagaatttatccctagtgtacaaatggactgtggaagcccattccacaaagagggatgctctctcagcctagacacacggggatggcctaggccctgccccaagtgatgtgacagactctgaagatcccccgtggaaggcctcaccctttctatggaacagaagagggatgggatggggattagtgggggacatgggagaatgggagatagagggacctgagattgatatataaaataagattgtttctaatttaaatttaaaaaaaagaaaaaaaaaaccctaggatccttgattttgtccttagtaaaagagtttcatgattggcctctgtattgttgttgggttttttttttttttcctttttttcttaaacccttttgctcttttggggggccccaccatccagctccatgtctggctgtgtagctgggtggctagccccttcttttcttgctcctctcctcttctatctttttctccttctgtttattctctctgcctgccagcccctcttgtcctttttcctgctttgctgtgggctgttcagctctttattagaccaatcgggtgttttaggcaggcacagtaacacagcttcacagagttaaacaaatgcaacataaaagaatgaaacacatctctgcatcagtaaacaaatgttccacagcataaacaaatgtaacacatcttaaaatattccacaacacccgtgtgaagcagagttgtaatacattaggggatttttaacatagagatgctcaggaaaagggtaaaattaccccaagtgagcatacggacttttcaatggagagtcacacttaaatatctttaaggtagccaaatgtgcctgggtgtgatgatgtgctcccctaatcccagcattcagtaaacaaaggcagagccaagcagatctctgtgacctctttgaggccaacccggactacatattaaattctaggacagccagaggtacatagtgagactcttgtcttaaaaaaataaaatacagccaaatgtacgttttttggtatcttgtgaagttgtatctcaaagggttgtcaatgaacttaaaaatgaggtcatagggtgatagctgtgacaggcttgggtagcattacagcttgataaaaaagccactctaggtcacaaggactgcagaggaagaggattttcaaattattttatgtgcacgggtgttttgcctacatgtatgactatgctctgcatgcatgcctggtaccaagatcacctggaactggagtggacagatggttggaagctgtcatgtggttaatggaaatcgaatcctggtcttctggaagagcaacccagtgctcttaaatattgagccattactccagccccatatggtggaattcttgattttcacccagcagaaacctcagtcagactctgggaatatggggacacctttcttttctcatgtctccttaattttctgtctttctgtcctgcttagggtaactttttatttttgttaacttctttttcactaataaaaagagccttcatgtccccctccccccataaacactgtcataatccctttaacaatagtacttaaggctgcgagtggtggcacacatctttaatcccagcattcctgaggcagagggcggtgtatctctatgagttcaaggccagccaggtctatatagggagttccatgccagggctctatatagacccagtctcaaaaaagtatttgtaaagtgtcccagcatggtttgtcatcaagtcttgttcaagattgaggatttttttttttttttttagttgttgagccctaatccaagacctcattctcttaaaagtttaaggtgctagagagatggatcagtggttaagagcactggttgctcttccagtggtcctgagttcagttcccagcaaccacacggtggctcacaatcatctctaatgagatggtgccctcttctgacaagtgtatacataataaacaaataaatttaaaataaaaatattttacatgtatttagtgttgggttttatgtgtgtgtatgtgtgtgtgtgtgcatgtgtctgtctgtgcttaccactgtgtgtggaagtcaggagacagctttcttcctccaccatgtgggttccagtgatgaaactgaggcttaacagcaatcccttttcctgctgagtgatctctctgactccagtcttctcattcttaataaaaatacccgcacagtcaatatttttttccatgtatgtgttcatctattttttaagtacatttacttactgtttgtgcgtgtgcacctgtgtggaggtaagaggacagcttgtaggagttagatttctctttttactgtgtgggccccaggaactgaaccagggctgtgaggctgacagttggaggtaagcacctttgttagacccccggaaaactcaggtatccggggtcccaggccacgactgcggtcaccccaatcaccagacagattcgagagcttgatgaaaactgcacgaggctttttgtaatttaacgagttaaccccatgttagcttgggtctttcacccacccgccatggcggatggctagcaaaagacggctcttagggcctcccaagagatcttataggacagcgtaaggggagtgtctaggggtatgtacaggctcacgattggtgtgcctccaggcttggagggcttgccctgtgttgattggtcaactggttgttatggcccataggccctcccagggtggttgctatactttgtgtgtcattgctgtgcgcttgtctgtaaagcacacccagggtcgtaaagcatagcgccaccagctaacttctgattggttccttgtcacgaggcaggcatctgactttctagtgtctaggacaagagaagcacgtgttcagccgttatggctgccaaaatggaagctggtcccttcaccttaactgctgagccaaatcggccccacatctatttctcttgagaatgttttatctacatgtaagtgaagaacttatgttgtatttctgatttaaagctactgctgaaattaaatctggataaaacttaccctttggatcctgctaaaaaagaaagtcattccccctcctcccttttttttctggtttgaatttatgcatattccgcattctgatgcttcccccctcctcccatgtctccacagctgtgcatgccgaaagggctgtctttcagaacgcaagccgacaataaagaacctcagttccactcatttataatcacccgggaagatggctctcgcacctatggctttgttctcactttttatgaagaagttacgagtaagcagatctgcacagcaatgcagactctgtaccagatgcataacgctgagcagtacagcagcgtgtacgcttcatcctcttgcagtatggactccctggccagtagcattgatgagggagatgcaacctctcttttgaaactccagcgatacaactcctacgacatcaacagagacaccttatacgtttcaaaaagtatatgcctgatcacgcctctgcctttcatgcaagcctgcaagaaattcctcctccagcttcacaaggcggttacctctcagcagccaccacccttgccgcttgagagctacatccataatattctctatgaagtaccccttccacctccggggaggtcactgaaattttacggtgtttatgaacctgtcatctgccagaggcctgggcccaatgaactccctctttctgactacccccttcgagaggcctttgagctcctgggattagagaacctcgttcaagtgtttacctgtgttcttttagagatgcagatcctgctgtactcgcaaggtaggtgtcctttgcatttcctgttctaaaaacaagcacttcagccctgaactgctttgtttccttacagaatcaatcactgatcttgtctcttctgcataaaaagaataggcttggatgagatgaaatactagaggttttttctgtttgaagtgacagtggctgcagagataaacaggaaggagttgaaagtgttgttttgaccaatttggttatatttattttttaacgaaaacaactctttatccacaacattaatcattgatttgtgttgtaacctgttactgttactaatggactctctttcattacaaactggcaaagttttacatgaaaattcaggtgacacttgaaagtaataaatgtaatgtttactctgcaacttcctgaggccgacaactttggacatttgcctgtaggggcatttcatgggtgacaaagagaagacatgcaggcgagaaacagatacaactgccctagacctagcagcagatctgctagagttgtgtgtagttgtctttttagcctccaagtcccagaaggtgttacctttattgtatcttttattcaaagttctcccaacacagatttagttaagatactagcaggttgaattttgtttcactattatatttttgatgattggtattgagcctagcctggatatctgttcccatctgaatattaatttacagaagaaatagagatgctgtgtcataaatagatattggattgtaggagattgtaaaccagctgtgtgcactgttaaaactttggaaaatatggcacagatacttggattggcattttgctagtttgtatttaggctggcagaattgtggaacagtctccctactgtttgctgctatgtttattttttcactttccttttttatttttctattttaaattgtaagtgaaactgagccaagcaggctatatttatgcttccccatcttgtgtgtgtgtgttgacactttttgtgtgttgacagcccttcatgaggtttctcagtttatcctacacaatagtttttgataatgtgttcagtattgcgctttgttgtcagagagttctctaatggctgtctgagtcctttatgttccttctgctctcattttctcagtgctcactcatcattacctgtttattgtctgcttgaggctcggtagaattggggagttgcatgatgtcagctctcagtgtcagattccagactgtttcagattttgggattagaaatgtttaagtagggcagagaaatggtgcaggggttaagagcatttactctccatggtctttgcagatgacttgggtttggttcccagttccaggagatcttgaccttcttttgacctccaaggacactaggaacacgcacagacacacattcgagcaaagcctcatacacataaaacaaaataaatgtttaaccggtattggttttagaagtcataaatgccttagtctcaaacctctgctctgtcccttattaactataagtgctgtacgtgactgacttaattttcacaagtgttgtttctcgcccccatgtctctgggatgtttttgccacccacccacccctgattaattgtgaaagttaaatgagaagacctatctagaatttttagactatgtgcgatgttccttatatccagggggaaattggggaacaggagagataagtaaccatagcacaactaactattgtggtaattccaaaattgaggcttagatcagcctctctccagatgactaaaccatgttggtaactgtactggatccacacatgatctctccttacctgtctcagtactcatttttaaattatttactcattcttcgggcatatgatcaatgtgctatactaaatatttatagagtataaaatgaaaactttgtgtaaatgcaacgtgaacagagttttaaaggagtcattttgtcagtttgcactctggtgccctttgtgattctgtgtgaggggttttaaggatatttgctacttcatttgttacatattgataaatgtgtgctgtaaaatttaaaggtgcttcatgagccaaacaattaccatgaaaatccaaagtgaatctaagtagatggatttcaatgatgaaagtgttcattgaactgatttgaaatctcagtccacaatttatgtagacagattgagtctattgtctagagagtaattccgtcacggtctttttttttttcagtgagaattcacccaggaagccaaggctctttcctggcaccttatgtcagaagacataaggcgtaaccctgaaggttacatgaagccagacatcgtaagatgggagtatggccctcttttcaaaagaatagcggaaatataaacgatggggaattttaaacactagtgtctgacttttggtaccaataattaaagcctctagaacacttttggggcttgattacttacctcctttcggtcttcacagaggaaataagcagttactgccacctacaccaacccttattcctgttcccatgtgcctctgcagggcttctctgccattccatcgctgtgaggaaagtaaaagctcctcggagttttcttgaaaacattgaaagtcttttcattacatgctgctagtcatgacaaagtagaccttgtttgttggttgtagtttatcaatcataaaaaggaaacctaatattctgatagaaagaaacgatgcttccatgaccttgacccaaaaagcagtacaatttaaccagttttgattaatattttagtattactagatttggggggtaaggggcgtgaagttgccttgaacatgttaggcaaatgttctaccagtgagcacatctcccctactattagacctattttatgttaagcataaccttattgtcattaaaattgtttgtctttttttgtttttccagacaggatttctttatgtaacagccctagctgtgctgaaactaactctatagaccaggctggccttgaactctcagagatttgcctacctctgtcccccatgcacctgggattaaaggtgtgcaccatcaccgcctggcatttgtccttttttttttttttttttttttttaaaaacaatagggtctcatgtggccctggctggctttgagctcactctgtatctgaggataactttgaactggcttacaaacatatgttgtcatgtctagctctacttgtgttgtttttaaagcagtaaggaagattttattcaggccaattgtgatagatatatgggactatcctgtgcaagctgcctttaatagtctgattttacattgcccatctatctgaccatatgactatcataagttagaaaagattcagatgaaaaggtctttaccattgtgcctgctcttttatcactgctagagaaacagtgtatggtttagccagtccattaagctgatttgtttttggcttcctcagttgttgtcttaaaacaagacatgcttgggctggagagatggctcagaggttaagagcactgactgttcttccagaggtcctgagttcaattcccagcaaccacatgatagctcacaaccatctgtaatgagacctggtgccctcttctggcctgcagggacacatgcagacagaacactatatacataataaataaatctttaaagaaaaaaaaaaaagaaaaaaaacaagacatgctcatttgctttggagctgccatccataaatcacgtcaccctttttggccctttgagaggcgcatgtccaaatgacagtggaacttgcagattcccatataattccaaccagtcctaaagggaagagatgctctgcatttatgtatctctttgcactcagtgttagcaagatccgtataaactatttacatttcttcatgccactttccctgcagagagtttttctgaccttacaagatactatgagtacttcagatttcaagagtatttgatgtacttcagtcatgggatctgttttgtttactatacaattgcaagctcatagttgctcctcaaatggaaattctgtagttcattgcccctgcagtggttactaggaaataaagatatttaacatagtcttcatagctgtttcattgaggatttgtcagtatcagcttctggtttacattgtttgctcaggaagacctattcattcccatttagtgtgtctaattagtatgacttgaaaagtgagtttatttaatttctgtcctatagcaatacatactacatagaaaaagtgttcccataaaacatgcatgtaaaccctgcttaaatattctaattcattttagacttctaccttaattccataaccctaactttttatttgtttagtttttcaagacagggtttctccgtatagtcctttctgtcctggaactcactatgtagaccaggctggccttgaactcaaagatccacctgcttttgccttctgagtgctaggattaaaggtgtgccccagaactacccagcataaccctaacactttaatatcctatcatactaattatagcttggtatatgaggcatctctgtaaagttgttccagaaacctttttctacccctgaccacttatatgaacctgtacattaggtcttaggcctcttgtaaggagttgtgctaagggacactagtccttttgtctatcctgaatgtggattatggcccaaacaggctttagtttatatttttattatttttttagtttatgtgtatgggtgttttctgtgtatatacatgcaccctttggaactggagttacaggcagtataagccaccatgtggatggtaggaatcaagtccaattgctctagaagagtagcctgtgctcttaaccacagagctgtctttctagccccacagttgatatttcttttcttttttggggggtggggggaacatcagattccctagaactggggttagacagtcgtgaactgccttgtgggtactgggaatcgaacccaggtcctcgacaagagcagccagtgctcttaaccactgagccatccctttagtccccagtctaatgtatcttgatcttatccactcccaactcattcctttttctataagattcccttcccatgtttatatttttctccctttcccctccccttccctctgttctctcctcccttccctttctctctccttccctccttccttcttccctcactctctccttctccctctgaccggccccccatctctgtaactgagtgagttcagttaatgcttcctgctggaacgttgactgatcttgtttaggtaaaatagctgcagtgagttcatgagtttacatgcctaggagacagcatctcacagacttcttgttcttttctccctctcttccgtgacatccgctgagctttgtggaagtttatagagatgtcccgtttatgaccgagcactcagtggtcacttattcttagtacttagaccacttaggagtttctgcactaatgcttcccactgcagaaagaaacttctctggttaagactgagacagtgctaaccggtcatcatgtcctttttgttcaccccattgtgctataagtttccatattgttgagatgagtgccttgactctcctcccacttcatatccttttaaaaatgctttttttctttgtgtggtgtgtgtgtgtgtgtgtgtgtgtgtgtgtgtgtgttaggggccagtgggactgtcctgctgatgtgagctcagttcttagaacccacagtggaagaagaggactgactcctgaaagttgaaatttttttttagctgcatgcacatagtaaataagtagacaaaaataaataattgttttaaaattgttagacccccccccagaaaactcaggcctctggggtctcagcccaggacctcagtcaccccaatcaccaggcagattcaaaagcttgctgcaaactgcatgaggctttattgttgtttaacgagctaaccccatgtaagctcaggtctttcacccacccgccatggtggatggctagcaaagacagatcgaaggggctgcaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccagggtggttgctatgctctgcgagtcattgctgtgcacttttctgcaaagcacacccagagccgtaaagcatagcgtggccagctaaacttctgattggttccttgtcatgaggcaagcatctgacttctagtgactaggacaaggtcatggcaagcacgtgttactgttgtggctgccgaaaggggcaggcatctgaccttagtgactaagacaaggtcagacaaatacgtgttcggctgttatggctgccaaaatggggagctggtcccttcaaaataaaagagagagggaaactattcagaagtcagttctctcctccacccaatgcagaaaggtctcttgtttctgctagctgcccagtgagtttctaagcgattttctcgtcccccttgtcatttccccatagggacaccgaggttacacacatctggctttttacacaggttctaaggctccaactcagatcttgcggcggcttgtgtggtgttgatgttctagtttcatttctattgctctgaccgatttaggggagaaagggtttatttggtttgtaattccagatcatagtccatcactacagggaagctactgcatcaggagcttaaagcagctggtcacatcatgtctgtagtcaagcagagagaaatggatataggtataccccttgcttgcttacctgtgttagacccccggaaaaactcaggtatccggagtcccaggccatgactgcggtcaccccaatcaccaggcagatttgagagcttgatgcaaactgcatgaggctttattgtttttaacgagctaaccccatgttagctcaggtctttcacccactcgccatggcggatggctgcaaagacacctcgaaccggctgctgagagatcttgtagggcagcgtaaggggagtgtctaggggtacacacaggctcaggattggtgtgcctccaggcttggagggcttgccctgtgttgattggccaattggttgttatggcccataggccctcccagggtggttgctatgctctgcgcgtcattgctgtgcacttgtgtgtaaagcacacccagagccgtaaagcatagcaccaccagctgacttctgattggttccttgtcacaaggcaggcacctaacctctagtgactaaggcaaggtcatagtgagcacctgttactgtcatggctgccgaaatggggggctggtcccttcacctgtgttcagttagatttcctctttcagagcacatggtaagaacttttaccctgtttaccgggatggttgtccccttgagtgtatctgaatcatacgcctttgtttcacagtgggatatggctcctgtatcaattgaatcttgttctattctgaaacatctaaaaatttaaaaaagccaattttgatggcacatgcttgtgacccgaacacttgagaggcaaagacatgagggtctctgcaagtttatagcctacctagtacacacagttggcatacaggtcagctaggactacacagcaaaatctgtctcagaaaaaaaaaaaaaaagtgagaaataaagtcaccatcctagagtagacaccatgataaagattcttttggaaactgatgttcccccagatgaggatcttcacattatattcctgtagcttcttggttttgctcctctcctacatgagctaaggtcttagaagtgccctgttgtttccatataatttcaccccttggagaggggagattgaacctagtggccaagctcagaccaactgaaatctgagctttttccagcatcaagctctaacataacactctcctctaatttcattttagttctttaaaaaaaaaaggaaaaaaaaaagatgtttatttattacatacagtgtcctgtttgcatgtctgcctgcaggacagaagagggcaccagatctcattagagatggttgtgagctaccatgtggttgctaggaattgaactcaggacctctggaagagcagcctctgagccatctctccagcccctcattttagctccaaaataaccaggggagtttatatttcattattttattattggtttgcattcctttaagtgtctgtaaactgcctcccaagaattggatccattcctgcattccattggaaattgatgattgatcccagtggatcttactcccttccatggggactatgtgaccacccggagccaaaggatctctacacctgattttcttttttattgagttcagggtttgaaatgaagtctcactctgtagccccagatgacatcatgacactctgcttccatatccccacacctggcacagctcctccctttcatctctccacacactgcgtgtttccacaactcccagccattctagcaagtctaatgttttctgaaactaacaaataagaggcctttttcattctttctttcttttttttcccgagacagggtttctctgtggctttggaggctgtcctggaactagcccttgcagaccaggctggccttgaactcacagagatccacctgcctctgcctcctgagtgctggggttaaaggtgtgcgccaccaatgcccggcttgagacctttttcttctagcctccagttctgatgcttactaggtgataaacggttcagttcagttctgacattacccagagttaacaacaaactacagatttaaacgttcaagcctactagaatctcacttttgattctagtcataaatggaatccctaggctacccacctttctttctggctgactataaattcagttttcctgatagtctcaccctttgttttttgtttttaatattgttttggggttttgttgttgttgtttgttggtttttgagataaggtttctctatatagcccacataggccttgaactcatgatcctcctgcctcagcttcctgaatactaggatttcagatttgtgccaccaagcctggctccttgggtttgataatctggtagaacaattcacccaagtaataagaagcactttatatacttacaatcagctattatgaagaatacagcttggaaaggccaaatgaaagtggtgtagagcaggaaggtgcaggggaggggcttgcacgtcctctttaaggataattctgtagccacctcaggatgttccctagcctggaagcctccctgtctctggtgttctttttaattgtggaaaataaagtttaaacttgtgttgcacaaattctaattgtttttaataataaaaactcaggctgggtggttcagttaatcccagaactggggtggcagaggcaggtggatctctgtgagctggaggccagcctggtctacagagaaaccctgtcttgaaaaaaaaaaaaaaaaaggtgggtgggggcacttaactcagagagagctgttgggatgaaagttgaagaattagagaagcaaagtggccagccactagagttctcacctctaccagtgttcagaccaaaagggagatcctgtcctcagactgtctcctcagactgcctagattgcttcagactgtttcagactgaatgccttgagctcctgtctcctctgtccatccagccatatcacttcctgtctccacctccttaatgctgggattaaagggtttgggatcccaaatgctggggtcacatttgtgtgagctttgtttctcttttagacagattcactctcatgtagcccagggtggccttgaactaacagagacccatctgcctctgtctcccaagtgctgggagtaaaggtgtgtgccaccactgcctggcctttatggttaactagtgtgactactgggattaaaggtgtgtatcaccactgcctagcctgtatctgactagtgtggctagctttgcactctgatcttcaggcaagctttatttgttacattataaacaaaatatcaccacaaatttgtgtgtgtgtacacatgttgcagcacgattgtggaggtcagaggacaacttttaggagtcagttccaccctccactttgctgaggtagggtctctatcatttctgcggctgcaatatgtactctgggttagctggcccacaatgagactggtttgagttcctaatcctcctgcctccatctcccaagtgctaggcttttactctgttttgggataagtctcactaggtcatccaggctggcttggaattatttactgatcttcctgtgtcagcctccaagtatttggtaatacaggcccatacatacacctaacatttttgaacataagcacttaacctgatactattcagcatctttaattcagataactgatctgggtcgtagctcaataatagaacatttgcctagaatatgtaaggcccggagcagcattaaaaaaaaaaaaaaaaaaaaaaaaagtttttctttgctgttgttgtttttttcttttcaatgatgggtctcacatctggtgctggccttgagtttgctattttatttttatcagggatgactttgaacttcttattgtttcacatccacctcccaagtgctggggtcacagacatgtgcccgtgcctagtttatatggtgctaaggagtgaacctgtggcttcatgcatgttaggcaggtattctgccaaccgagctatgtgcccagggttaggagtataggcgaggcgagtaccaccacattcagcctttctcatttgcgttctaagcataaaacttaatattaggtctacatgtcattcacttccgattctgggccaactcacctgcccaagttttgtttaggatttatggagcaaggaggagggaggaaggagagagaagagtgcatgaatgagtttgaatatccttttgtgtggggaaggcatttgtgtgccactgtatgtgtgttgaggtcagaggacaactttgaggtgttagtccttgtctgtccactttgaggcaggatcttttctctgctgtacatgccaagttagctggccttcaaattcccactgtactcctatctcagtcacctgtctcccaggagggacagtgggatgagatgctgtactacatcgtactgtttaggccaattaattttatgttaacctttttctttgacagctttgtacatgcatgtaatacattgtttttaagattttttttgtttattgttagaggaaatatatatgacacagtgtaagtgtagaggtaagaggacagtttttgggagtcatctgtctctactgatcctaggagttgaactcgggtcattaggcagtagcactcttacacatctgagctacatctcgttgattctgtaatgcattctagtaactctaatctttcacaccttctctcatctcccttcccacctccacaaaccaccttcctccctacaagtctcaggtgcatgcatttttgttttgttttgtgactcactaagtttaagtagggccatgtccctgggcatgtccattggagcctggtggatattctaggcaaatttttgaaaatatgttttactatgtaacatagccaagcataattttgtcggtattcaaagttatatttcattttacattccttagttgttaatatacacatttattggccaattacaatgtagtaaaccctggattctattctgaaaattctgagattagaaatatagtggtcaactttgtgtggtagtataagcctttaattccagcattggctggctggctggctggctggctggcagaaacaggcagatctctgaattgaggccaacctggtctaaatagtgatttccagatcggccagggatacatattacgaccctatctcaaaataaatatagccatcacttggggctggtgagatggatggctcagtttttgggattttcttgggagttagttttggggttttatgcatgtgtttgtctggaagtttctccttgtttttgtttcactttaaatacaaacatttgtcaggtgtgatagtagactttgacactcaggaagttgagacagagggatcagtttagcctagtagtatgggaccagtctgggaacacagcaagactacatctcttttataagaaaaagtgatgcaggaggtggctcagcagttaaatttgcttttcattatgtctaacttgagttgaatccctggacccacatggtggccagagagaaatgactctttcaagtcattttctaacctccacaggtgacacacatctatcttgcaccctcccccattctcccttccactaaatggatgtgtaatttttaaaagtgtgtgtgtgtgtgtgtgtgtgtgtgtgcagagacagagacaagtatacaaaggaagatagtaaattagggaacagaggcatatcaataattataatagaattataatagtttagacaagatagataattaatgttgtaaaagaaataagaaatcctagcacttagagggcagaggcaggtagatctgtgtgagtttgagaccagcctgatctacaaataagttcccagacagccagggctacacagagaaaccctgtctcaaaaaacaaaaaacaaacagtaaataaaaaattaagcgagtaaataaatgtgcttgtggtactttgaataaaatgactcccttgggttcatatatttaaatgcttaggtagtggcactatgtgaaagacttaggaggtatgaccttctctggggtaggtgtggccttgttggaggaagcttgtggggggtgggtatcaaggagtagcatgagttctaatcggttttaataataaaaacctggagtcagttattggcattaatactgaagatcagagaaacaaagtggccagccactagatagttcctttttttttttcccaagatgtatttacttattatgtatacattggtctacctgcatgtatgcctacagtaggccagaagagggtaccatatcttactgaagatggctataagtcaccatgtggttgctggaaattgaactcaggacctctagaagagcagccagtgctcttaatctctgagccatctctccagctccactggagagttcttacctctaccagtgctcagaccaaaggggtgatcctgtcctcatactgcattctcagactgcttagactgctcctcagactgctctgtctctctcttttgtttcctcttgccttacagtcttctcactgtatctcactccagccataacacttctgtctgcaccaccctagtgctggcattaaaggtgtgtgatcccaagttctgggatcactttagtgtgagctctatttctcttttagacagattgaatctcaagtagcccagggtggccttgcctctgtctcccaagtgctgggattaaaggtgtgtgccaccactgcctgacctctgtggctaactaatgtggctagctttgcactctgatctccaggcaaactttatttgttaggtcataaatgaagtatcaccacatcgggctttgaggtctttagaatagaacagtaagatggtgctgaatgggaagacggctcagtcagtgcttgccaggtaagtgtgagtacctgagttgaaatccctattactacataaaagccagctgcagtggtacacacctgcaacttgagctctgaggagaggagtggtgaaaacaggtctctggaggccagtagccaggcagtatagccaaattggtgaactccagtgtctcataaaataaaggtggaaagcaattaaggaagacatattacatcaacctctggcatgcatatatataaacacaggcaaaagaatacttaaagaagcattttgttcttttcttttttgctgtgctagtgattgaatacaggctttgtgcatgctagacaggcatcctgccactactttattaccagctcctgctgtttatttcttgactgagttaaaagggatgctctacctctgtgaagcagtctcattgctaaaaagtgtatgatgtatccaccagtcatatagagaatccaaacctaaaaagattagacatagaacatttacaagtgggaaaacggtagtaaaggaaaaacaaacagcgtccctgaaagtccagaatagagaaaaatgtgtaattaatttttacttcccatggtgttttttctataaataaagcaagaagataacacacagtacaaaccatcattacttgaagaaagtgtattttccaggagaccgcatatttctccagtcacaagtaaactagctaccttgttaggaatttagtttgtccagatcccttttcttttcagtttaggttcacccaggagacagaaatcataaagtagtttaggatgaggaatgtaatatgaattgttttggaaaataagctgtaaagtgataaactctgaagggtactcagtgaagcacaaacatttaagtgggaacccagaccccaaagctgtaatggattcctcttgaagaaattctgttcataaggtgtggagaaggccagtggattgcttgtcagtatgtttcctggaccagagctgatccttggccactgatctaacagaagacaaagtccaaaccccatgttgtctgtgactggtggaacagacccacaggacttgtttgaatgtcactgtggtatgagatctgagattgcagggtagtagagaaccatatgaggaagtagccactgactgctcagtcttggcatgtggcatagcagtgtgccccctgataccttcacacacccacactgctggtcttccaagcagcaagagcaagacatattgcatactgacaccaggaaactgtgtgtctccatcgccctctactggcaaagtataatattgtattcattgtcaaaatgggtagaggccaatcagttataagaactggatgaatttggagctgagaggcatttaatgaataattggcacataatttgcttaaagctccaagctagccttccacattatctggcatatgatggagaaagaaataataaaatcagacactaatgtcttagaactgatagcccttgctgtgtctatggactgatgtgatcctcatgtctaagccgtgcttttctgtaggacttaaacaaccccaaaagaataacaagcaatgttattatgtgctccacaaaatacacacactctctctttctctctctctctctctctctctctctctctccacacacacacacacacacacagaaccagggtctctctgttacataccaggcaaatgctctaccactatcctacattccttacactttatactcatcatagatcaaatttactgagatactgcactttgattttcttgtcggactttctttggactgccagcccccaaataatgacacagagacttattattaattgtgaaagcttggcctttagcttaatcttgttcaaaactagctcttataacttaaattaacctgcttctattcatctatgttctgccatgtaactttttacccttctctgttctgtatgtctggcttctgtgtctcactggagtctgtggcagcctcagattctgaccctgggttcctctctctgtctggaagtcccgcctattctcctgcatagctattggccactcagctctttattaaaccaatcaggtgccttaggcaggcgaggtaaaacatagacatatcctagcacagtttgctcaagtatccctcaacaagataactacctggtcacagagtacttcattttgacagcttccaatccaaagcaagtctctgttttcttaatgccccaaattatcctgcaaaatcccaaatactatactagtctttcttcactaagatgttccacagttcctgaagagtgttcatattatttctctgcaaaataaacccagctttgtctgtttgttttttttaaacagggtttctctgtgtagtcctagctatcctagaactcactctgtagaccaggctggccttgaactcagagatccacctgcttctgcttcccaagtgctgggattaaagatgtgtgtcaccatcgcctagccaaacccagtttatttaagtacaagctaattcctggggtggttttttttttttgttgtttggtttaactgactgaagggtcatagtaaaagaattaatttttttgtttttaaatttttataattgtctttaaagtattatgatgaacactttgcacataaacctttaaaaataactctagaactggatctaatttgccagtcggatactggataagggctcttgctaccaaggctggtgactagagttcaaccccctcagatccacacactggaaggagagaactcactcccacagttagcctctaacctccagaggtttaccataacacacacaaataaatatgaaaagaacaattgtgatttttgaaattagttttaagtaggtctctgagctctacatctgtgtatgcatagctagaatgagtcatttgctaatagttctccacaggtggatgctaaccatggcctagttattatatagggtatttggatttccttattatgtacttaggcatacgttaattctgttatataccagtagttgtactaagtaaaaaggttacaataaaaaatttaatccctggttgaaatctacagtatagaatccaaggacatttttctctggatttgttcttttggaggtgacggggagagggtaccagtgttaaaactgggttttagctaaataacccagactggcctctgtctcgtgattcacctgcctcacctttctaggtagctgggactacaggcaagtggctgtaacacggaagaaaaaaaataataaaaaacagagacagatattggccttcaacctgaagatcagggaagcaaagcagcctgccactagcttcttacctctacctcagaatgaaagggctgatcctgtgtccacgagctctcaccaagcctcaggctgtttcctcagcgtggctggagaatcctaagactgaatgtctcctgtcctccttgatacaaagccttcctgtgcagctggagaatcaatgcctcctactcaatactgaagatgctgcttccattttctatattcttctagtgtcgggattaaaggcgtgtgatctgttactcttttagactgattcaatctcatgtatccctgtgtggccttgaactcacagagatccatctaccccttaatcctgagtcctagaattaaaggtttgtaccatcacctcctagcttctagctgctaggatgaaaggtgtgttcctggcctccacattttaagagcatccagggctgtgtgtgtataatggcatatgcctttgatcacagcactggaaatacagagcagaaacaagctggtctctcagaatctggtctgcataggaagatgctggagagagaggcaggtggggaagagagagagaggatgcaaattgctcaccactgcttccaagaagagtgctgatgctgtttctgtacgttctgcaagctattcaggtgaaataatttaactctgtaattacaatgagctagaactgacctactttctccatggtcatgacaaaatactttttaaattttttaaaaggtttatttatttgttgggcagtagtgatgaatgcctttagttcctgcaaaggcaggtggatctctgtgagttcaaggccagcctggtctaagagtgagttccaggataggctctaaaactgcaaagaaacagtgtctttaaaaaaaaaaaaaaaaagatgtatttatgtgcatgactattttgtatgcattcatatgtgtgcacccatgcacctggtagcctcaggtcagcagaggggctcagatcctctggagctggatgactgatgtttattaggtatcgtgggtgctgggcatcaaacccaggtcctctgcaagagcagtaagttctctaaaccactgagccatctttccagttcaaaaacatttaacacaattttttttctgatgttttaggtttgctgcagcacctgttttcacttggattcttcccttttatttttcttgtcctgtacagattatcagcgcctgatgaccgtagcagaaggcatcaccacactcttgttcccatttcagtggcagcaagactatgtgcccatccaccctgcctctctgctccattttcttgatgcccctgtcccttatctgatgggtcttcaatcaaaagaaggaactgaccggtctaaattagaacttccacaagaggtaaagctggtcattcatgaggaagcacgctatttgttgacttaggtcatggctgtcactaagtaacattgtctttgtgcagttgttacatctgaatctcccagatactgttggttagggcctgagccctagcctgcaaactgtttcttctaatacttgatatagcacaactattagttaactacacctcaaagaaggacagtaacaaatttttacaacttatacatttctgaaggtggttcaataatagtttttttttaagattttatttatttactatgcatacaacattctgcttccatgtatatctgcacaccagaagagggcaccagatctcataagggatggttgtgagccaccatgtggttgctgggaattgaacttaggacgatcttaacctctgagccatctctccagccctcaataatagtttgatattaccattttattactctaaaagcattgaacttttttccatcctcgtgctataaattttgttttaaagtgtattagtcagagtactctagagtaacagaattcatatataggataaatacatacatacatgtatgtgtatgtgtacatacacacacacacacacacacatatatatacatatacatatatgtatatatggtctcttgccagtgaaggaacagacttgccagcaggatgagagcaaacaggaaaagaaaggggcttccttcttccgtgtccttctgtgggcttccagcagaaggcaaggcccagattggaggttattttttacctccattgaatggagagtgctctctttcagcaaacgagataatggaaacagcaaacactttactgcttgccatctttagctgtagccagttagtagcctattctcaatgttaccttgacatggtctgtaagacaaagaccccctaacttcttggcactttaatcttgttttcaaatatttaggaataaagtaatcaagagttcttgaaatcattttatatgtaatttttagctctgttaatgccactcaaatttgggatgtaaagctttaaaatgaaatattgaagaggatgccatggcctattaaaagcataaaacggttaatggcattattagctatttaattatcacctttcttaataaaaatcactttagcttgttcttatttctcatagggattctcattctaataagtgaatataagggctggcctgtggtagtgcatgcctttaatcccatcactcgggaggcaaaggcagacaaatctctgagttcaaagcctggctgatctacagattgagctccagggcagccagggcaagaaatcaaagtaaataaataattaaaaaaaaaaataaagcagtctttttaaagagatttaaatgtgtacactagtgatgctccctctcctttcctctgaaaactctgagagaaaatctagcaagaaagtttctaaagaaagatgccacttacaaaattattaatttaggaaagtattattttagttgttaggtggctaatataactgcctagacttataattaaccacctactccctttgctcatgattccaaaatgatagatgttagtagccatttgttatagtatcttttagggagtatatggggaaggtggaaaaatggagcactaagtattgattactaagtcttgtacctcaccctcagccattcttaaaagaatcagaggctgggattaaaggcatgcaccaccacatggcagctcagaactgtctgtaactttagtcccagggatctaacaccctcacacagacatacatgcagacaaaacaccaatgtacatgaaataaaaataagtctttaaaaataaatcttaaaaaaatgaaaaaggaaaggaaataaattctagtgggaattggagaaagaaccatcatgtactgctgatgggaatgtaaattgatatagccaatatgaaagtcactgtggacattcctaaaaaaattaaaaacagaactaccatatgacccagctataacattcctggatatacacactcaatggaatctaaatcccaacaccatagagacccctagatatccatgtttattgatgcactattcaaaatggccaagatagggaatcattatagctatgtatcaacaaatataataatacgaaaaaatgtgatttgcatgcacagtggaatttcattcagccataaaatagaaagttttgtcatttgttagaaaatggatgaactagagatcatgttaaggacataaacctggccaggtggtggtagcacaggctgttaatcccagtgttgaggaggcaggggcaggagaatctgagttcctggacaaccagggctttacacagagaaaccctgtcttgcaaaaaaacataaaaaataaataaataaacctgctcagaaagagaaatattgtatttttttcttatatggaaactagattttttaaatacatacatatatacatacatacatacacacacacatacacacacacacacacacacacatctctctctctctctctctctctctctctctctctctctctcaatgaaagtagaagtgtggctatgtaaggtgaggaagggcctaatgggaaggttgagagggtaactgagaggaagacaaagtctcacacaggatctaagtttaacatttgggaggtggaggcaagaggatcataagttcaaagtcatctcagttgcctaggtagtttgaggccagactgggataccaggggtggaggcagaggcaggcagatctctgagtctgaggctagcctggcctacatagtgagtttcaggacagcccaggctacatagagaaaaacctgtctcgaaaatcccaaataaatagataaataaaattagaaatgcattattatcggggaattgtgaacccctttgcaaatccttaactctcattgataaaacaagacaactcagaaagtagcaaagacaattagagctgtgggcatgatggaaatcagttgctgggaagattcacatagataagaaagttacttgttttgagttacaaagcaggcaaactcagcaatggaatcttctagcacccaaactgggagtcagagtcttcagaaatatcataaggatgcccagaggaaagtgacttagaattttggctggtatctgacaagataaataaaaaagagaagaaaacaaaccatactttcctaaaaagaacaaaagcttggcattgagaatatataaacagtgcattgcaggagggtttctggcattaaagggataattatttctcccatcttcttgagatgtctttaagtataatggacaactttcctgagggatgggtagtttcctatctaggtgattgtattaatcagagttcactagaggagcagaattgggggttatctatttatttatatgtattgttacaattatatataatatatttatacataattataacaattatatggcatataacaaatatattacaattatataatacacatttttcttatttatagggtaggttagtggaatgccttgtaggctgtggtccagctagttcaacaatggctgtctaccaacacaaggttcaagaacccactagttgctcagtctacaaggctggatgtcttagctggtctttagtatatgccagaatctgaagaagtaggctctaatgccagtgaagtaatggacttgccagcaagagcaagatcaaataggcaaaaaaagtaaacttccttctcctgtcttctttgtatagggtgccagccacaggtatacatctcatttaaggtggacttcccacctcaaagatgtagatttgaataagaaaaaaaatccctcacaggtgtgcccagtctttggggggttttagttaattctagatgtagtcaggttaacaacagtggtcagtgatcagtatgccaatttggattaacttaaaggttcgacaagaatacgtccatctttgagaaatttagaataccatgtctctacatcgagccagaggtatagaactcagaaagtattcttgtgcaaaaatcatatagaaaaaaacttttttggttttggttttttgagagaaggtgtctctgtgtaacagctctggctgtctgattgtcctggaattcgctctgtagaccaggctggcctcagatttacagagattattggcctgtgtctgcctcctgagtgctgggattaaagacgtaatcatgtaaccacctgaccaaaaatcatgtaacaagtaaattaaagaatattaaagaaaaataaataatctgtataaaatagctatactttaccatgaggaaataactgttcccttaatgagttttagcagtcttgctacctccacctttctgcctttcatatattttaaatcttttctttaacttttattgattctttgtgggtttcacatcatgcattcactcatctccccatcccctcacctccaccctctgcccttccaaccccccaaaacagaaccaaatttaaaagaaaacataaaaagaatcttttaattaatttttatttaaatttttaaaaatcttattttgcataccaatcccagttccccctccctccatccttttatttcccttatcatctccctatcccacccctcatccactcctcagggagggtgaggcctccgatgggggatcatgaaagtctgtcacactatttgagagagtatccctccacagggaataggctccaaaagcccattcctgcactagggataaatactggttccactgccagaggccccgtagactgcccaagtcctccaattgacacccacattcagggggcctggttcggtcttatgcatattcctcagatgtcagactggagtccctgatctcccacttgttcaggtcagctgtttctgtgggtttccccagcctggttttgacctctttgctcatcactcttccctctctggattccaggagtttggggagagagaagaatctggtagtggaagttgtagggtagcccgttgagtcacacagtttactctttacttggaagtgttcattgccacgaatcattggattggtctgactcaaggtctctgatttatactatgacacagctaatgggcactcattgggtctcctcttggatatcctgttgtcctgtgtcttggcgagcctgctggtttggatctcaagactggtgtattaccaaggatataggaggtaacatctagacctagttatggaaggaggatctatttaaatgatctccatgcctgataacatcctattagctacctaacatcatgaggggggggggcagtatttaggtgatgaaaagggaaatagagttagaaatagggaagataataactcaataaaatggaagacaaatacgaagtatatacaaagtataaatgtatgaaaatgccataatgagagggctagagagatggcccagaagttaagagcactggtcctgagttcaattcccagcaaccacatagcagctcacaaccatctctaatggtatctgataccctcttatgtcgtgtgggcatacatgcagacagaacactgtagacataataataaataaatctttaaaaaaaagaaagaaagaatgccataatggaacaagttcttttatatgctagaaaaacatttaatgaatgaaagattctgttgataaaggtcctgggtacaattcctatcatctcttcatacataaaattctgagccttgaaagggttgacttaagaggtggtgtgctgaaatggagcccaaggatccagtctcaatttccaacactgcatataaccagcagtaaatgcagtgtaaagaaatgatttttgagccaggcgtgggatgcatgcctgaaagcttaaggcacgagaggtggaagcagaaggagctggagacgagtggcatgctcatctcatctgtatagcaagttcaaggctagcctgggtcttctatttttaagatggtctaaaaatagtataatttgtttctgtttataatagaatattttagaacattgacttcttttactccaagttgtcaccataaaaacacagttctcaccttaaagggagatggtttattctggagacaagaatgagtgacctttaccagagagcacagatttaaatgaccctaataccatattctaacatggcaatggtttcatgaatttttcaaatgtgttggtgggaaaattaggtaagcaggttacagcaaagcagggacatctctcctataggcctcaagtgttacttgataacattctttgtgatgagggtttttgtttttgttttttgttttgttttgttttgttttgtaccaccagttccccaataatgacatggaaatttatgattaattatgaatactcagccatagcttaggcttgctctaactcattcttataacataaatcagcctgtcttttttaatctacgttctgccacgtggcttggttttctctgttctgtatcatatgcctgacttcttcggagtctctggtggaatccatgtgcctagctagattccttttcttctctctctctctccctggaaatcctgcctagcctctctttcccaggtattggccattttgcagataaaccaattagaaggtgccatggcaaagactcatcacagtgtacaaatattcttcaacaattcttactttaggttggtgttagctaaagggtctgggtggtaaattcctcacttacaaaggtgttaggccaatcacaggtgggcaagaaaatgcgatttatgaggctaaaaatagcccgaggtactttggctctgaatctacaattggaaccctttgaagtcatttaagttttaatagtcagccttgtacaagttctgaaatctctatgtttttggccccccccccccatttcaggctaatttgtgcttcgtggatattgacaaccattttattgaattgcctgaagagttcccacagttccccaataaagtagattttatccaagaactatctgaagttcttctccaatttgggattcctcctgagggcagcctacattgtagcgagagtgccaccaaactgaagaatatggttttgaaagatttggttaacgacgagaagaatggcaacactcccaccaataacatcagcgtgtatgagttcatgaagggcaatgaaaccatagcccgcctccaggctctcgctgataggactggcgtgactgtgggaaaaattgacctctcagcctctctgaatgaaaaagaaaaggatttcaaattacagtgtgaagaggcagaattgagggactaccagctcaacgtacaactacgagaagtctttgcctgccgctttatacagatgtttgctgactatgaagcgtttgtgattcagactgcccaggacatggagtcctggctgaccaaccgggaacagatgcagaactttgacaaagtaaaaagaaccatagttttcctctttatgcttactaatggcccacatttccagtcttttttaactttttaaacagtttacttatttttagtgcatttgtgttttgcctgcacgcatgtctgtctgagggtgtcagatcttggagttacagacagttgtgagcagccatgtgggttctgggaattgaacctgggtcttctggaagagcagccagctagtgctcttaaccactgagccatctctccagcccctagtctttttaactttttaagcacaggtttttatatttccctttttacatcctattaagtattttatgctagataaatagtttcacacaaaaacaaattcttgggaggtagaagcaggagggccaggaatgcaaggccatcctctgctatgtggtaagtttgaggccagcctgggatacctgagacgggtctcaaaaaaaactggcctttgaattgtgtattaaattggtgtgtgtgtgtgtgtgtgtgtgtgtgtgtgtgtgtgtttgattttcacgagtctactgctcttgtaagagttttatttactcttgtgaccaagtctagaaaaattaagcctgttccttttctaagagatgctcactgacagtttagtcctcccccaatgatgtaacacccaatttgttcatgtaaaggtaacagttcaatttcataagcctaattttatatcttttgtatcttaaaagagaacagatgagtaaatttggtttcgagactgttagtataagattatgttccagagtttttagaaaaggagactaggagatgtagtagctctttactgtcttactgtctactggagcttcttgctcgggttctctgtgttctgtccaaggcccttcatgtaccccagctctctccaacagacaaaagcactagagatgtatgtgaagtcatttaggtcaccgggatgcagttcagtcctctacctctgttagtgaacaagcataatgctgctgttagaatgtgtcataaaagacctcccccaaaagagctattacactccaagatgctaagtgtttaattttggagcatctggcaaacagatattaactaaatgctttgtgtagtatcaaagaatattttctgatttcatcatattttttcttatggaggataatatgccatgtgcatcagaaattgctggtgtactttatgcctgattaaacgtctttaatattaagaaaccacttttcaaatatatttccgccctgggacctgttatcatatttgcttagttttcattatgctttctctccagtttgagaactaatcttacatattcatgatctatctttggggcatgaattcatatttaaatttaaattcatatcctcctagtaccttgttctttcttactctctatgtagcttcattctagaagtgggatcctttctgtataacccctaagaaaatgaaatttacatgtcagattccagaaagctagagtcatcttatttttcactaaagaagtatgcagggcatagtcatcttgaaagtcaagttctggttgattttaaatcttacagagcacatgaatctaaacatcaaaagctagatgtttgcccgattttctaagggggggggctgtttctttcctatacaaagtaggtttgatgtttatctatgaagtaacattaaggagatggattgatttctggagactgctatgagtctgtctggatatttgtacttacataagtacatttaaactatggaagcacttaaatcaaaaagtggactctgtaaaaaatcttttattaaaagtaccctgaaataataaaatgggaaaattaaatatgctaggaaaaaacttgataaatactaaaaataataaccttatgttggaagtgtccttccatctttctccttttggctctgacacactgcatctaactttgaagagtgaaagaatgaaaagaaaaaaaaaaaaaaaccaaccgagtaactggactaggaattcactcacaagtttcagctcatcttaaccaagatgagacttcctacatatatcgtacatgagctgaagagagcaacaacaacaaaaaaaatgtgaacacttcagattagaagccaggtataatttattgcatcaagcaaactggcaagagggaagggtagcttgttcatttttgaagatcatttgtatgttttttttttgttgttgttgtttttttgtttttttttttttaaggcaatgtttctctaagtctcagatagttgtgtcaacacagatatggaaagagtttaatcttgagttaacaagaagagtgaacctagacaaacatctgcttgaagaccaaaacgattttgcccataggcacaaattccatgttattattttaaaggatttatttttatttatttatttattctgcatacagtattctgcctgcatgtctgtcttcaagccagaagagggcaccagatctcattacagatagttgtgagccaccgtatggttgctaggaattgaactcagaacctctggaagagcagtcagtgctcttaaccactgagccatctctccagcccccgtgttgttattattaagttcgtaattgaacatatgcaaactattgtgcatataaatgtgtgtgtacatatataatatataagcagttgctcatcttcagccttttggttagaggttcatttcctaggctaggaacagagaacatgagagatgactcactgggaagaagaatcagaatgtaatggtaagtcacgtcgatggttgacagtgcatccaatagcaacttatcggccatcagtcattattgatgtcctctctcctgggcagtggtccttgggatactaatataaatcagttttgaaaggtaagatcaagctagcatcctcagtgaccaaaaactctacaaacttagaggaaaggggaaaaaaatggactggcaagatcttaagtgtcaagcatcgattgtatgtgttataagtttaaaaagtaataaccttaacaaactgttcatgttcatcttacataatattaagacgacctcattaaagtaataatttgctaattatctccttacaggcctctttcctctcggaccagcctgagccttacctgccatttctttcacgcttcattgaaacacagatgtttgccaccttcattgataataaaatcatgtctcagtgggaagagaaagaccctctgcttcgggtctttgactctcggattgagaagatacgactgtacaatgtcagggcgcctacgcccacccttcggacatctgtgtatcagaagtgcagcagtttaaaagaagcaggtatgtttgccatggcttagaggaaaataatccatgatcatttctttttatagattgttgacttatataacacaaaattaattttctccttttttgggggggggtttgagacagggtttctctatatagccctggccatcctagaactcactctgtaaaccaggctgggcctcaaactcaagagatctgcctgtctctgtctcccaagtatcaggattaaaggtgtgtgcctccactgtcctgctaaagttaactttcattttaggacatcaggactaaccctggtattatcaagaagtatttttatactttttcttcagatttctgtgaatcactatttctgttgacattcaaaagatgcagatttttgctattttcttgtgttagaaaaaaaatgttaacctctatctttggtgttatcaacttaaagtagttaacccaaaactgggcatggtggtacgtacgtgcctaagtcctagcactcaggaagccaaattcaggaagcctggcaccaggcatttaaagccagcctgggtaatgtagcaagattttgtctaaaataaaaacaaagcaaaaaggaaatttagttatgtaaaatgctgtctagcttacataacttcaacagtacatatttgctttgtggtacagttagtcttgaaattaaatccttggatttttccattcaaattaaagtttcccccaaccctaacaccaatttccttcaaagaatgatgaattttccttgtctgattgtgaaatatgctctgttaaataaataaccccactaatagccaacatttgagcctttcttacatgccagttatgccagtgtttgttttgatatgcccttttacatgtacccttaatgacaggggtatatacacaggtatttttgctgttgctttattactattattctatgggtgaggaaactgaggggttaaagaatttggctgtggttcttctttttggttttttttttttttttttttttttttttttttttttttttttttttttttttttttttttttgttttgtttttcgagacagggtttctctgtgtagagatctgcctgcctctgcctcccaagtgctgggattaaaggcgtgtaccaccaatgcccagcttggctgtggttctataactagttctcagtggagccaccagttggatccagatttgactgacttccagtacctaacatcttatccttttattggtaggcttattcattaacaaatatgtaaaacgtaccaattcatggggttttgcacatttatgcctagttcccaacccattctttgctgaatagaaacatatatccttttatttctttccattaaattaaaagtggcacttttgctaggcagagtgacacatgcctttagtccaccacatacttggggtcagaggcaggcagatctctgtgagtttcaggctagcctgtctacagagcgagttccaggacatccaggcctacataaagaaactctgtcagggacgggggccgtggggggggcgagaggtgtgtgtgtgatattttttatttgagaccaaatgttctactgtataagaggacacaatggtgtgtagcttctttgctctgcttctgttggttgcttagtccttcctttccatctctatttaaacagttcagtcatggaagtaataacgttgctttagcatttccaaggaaagaagtagtaaataataacttttatgcagtcttcaaggcacattgttgtattcctatgtataagggtgattccttggagccccttcaggaagtggcaagtctctctgtgtttctagaagctgaggagatagaataaataaagttgttgagagaattatgacttttagtgcttttaatagttatgtaaataccttgggaaaatctcatccctctcttcctggcagaatttttaaaatgaagtacccagagttccttagcttaacctgtgtctgggaaatcttaccaattaaaatggattttctctttgccccttggagcctgataatctcactctcatctcagaaactgtgtgaggtgcttttgaaaatagtaccattatagacttagcatgcctgaaaataagattaggttatggccatagttgccaggaattttgaaaaagtaaaaggagactgttgtctatggctcccccattcagcacagataataaattggtgtgtgtgagggagggaaggagggaggagagagagagagagagagagagagagagagtgttcagtgctaggaatttaatgcagggccttgccttgggcatgacagagaagcacacgactactttttatatttctttgttttgagacattcccagtcattgcataggaaagctttgaaccctcaattctacttccttggcttcctaactagctaggggttacaggcctgtaccaccaggcctggctccgttcattctttacaggtgaacctgtgaggcgcagactgtctactgttgacactggctccagagccttgtgattacagaaaaaccagaaatggatagtaatatgattttctttctcctcaccaatcaccacaaatcaatattgatacaaacccttgaaacttttaacaatagacccagcctctgacctcacaaagcaggcatttgctaatttctgaatattcagtattccctggcagtataagtactaaaaagttacattgctgtgtgctccctatggatggatatctgtaatatttccaatatttacttaaagctaatttttctacattcatatttctgattcccagagacctgtgtgaaaagctttttcagggtaagaggatgacttgaggtttctgtaggtgcatgaatgtatgatacaacattgatttttagaaacaaaatgcctctaatttattgtaaatttaatttatagcccagtcaattgagcaaagactgatgaaaatggaccacactgctattcacccacatctacttgatatgaaaattggtcaaggcaaatacgagcaagggttcttcccgaagttacagtcagatgtcttggccacaggaccagccaataacaagtaagcattcgttttacctgagtgatgagtttaatgaaagaaggtaattgttctccagtgttagccaggcagtgtgtgaacattaaatatcttacctattacgtctttaaatttaattattcctttgaaagcacttgacttttaattgttatgttaaaaaaaaattctaaagaccagggattttttttcacagaagtattaatagacacatttctttcttgtattcttttttttaatttgtgtttttgttactggtattgacagagtctcaataattaaaacagactaaactagaattcagtatataatcgaaggctggcatcaaatatatggtcttcgtcagcatcctttcctttttctttctttccttcttttcccccatcctatcccagtattgcagactgaacccatggctctgtaaccctatgccctgtttttttttttttttttatccttgaagtgctagaatcaaacccaagtacacagttaaatggctacattaaaacagtctggggtttgggttttttgtttgtttgtttgtttgtttgtttgggttttttgggatttttttggggggaggttcaaaacagggtttctctgtatagctttgaagcctgccctggaacttgctttgtagaccagactaccctcaaactcagagagataatgcctgcttctgtctcccaagtgctgggattaaaggcatttgccaccgcccagcttttttttttttttttttttttttttttttttaaggggggtttttttttttgtgtatttttttctcgcccttttaacagctctggctgtcttggaactagctcggtagaccaggctggcctcaaactcagagatccacctgcctctgcctcccaaatgctggggttaaatatgtgtacctccaccgcctggcaaaacactgtcttaatactaatcaggggtggtgactttgccagtaaccctgatagttgaaagggagacctagaaaaaaatttgaatttaaggacagcttgaacaacatagcaagtttgaagatagtgtagnnnnnnnnnnaccctgtgtcataaagcaaacagataaacactgaacttgaaactttgctaaaaaatgttggtgattatggggctcagtgtattcactttttaaaagatttatgtgtattggtattttgcctacatatatgttatatacaccatgtgcatgcctggtaccagtggtagctagaagagggcatcagatcccctagaactggagttaacagatgcttgtgagccactatgggtgctaggagccaaatccagttcttctgtgaggtcagtaagagtaactctgaggtttatgtttggtttttgtttgtttgtttgagacatgacctggtattcctggactagccccagactttcagttcagattgctctgaacttctttttcatatattttctatttattctttgagaattttatacacatatacaatatgttttgatcatatgcacccccttcttgttctccagcaatcccctcagtgctcctgattctctctctctctctctctctctctctctctctctctctctnnnnnnnnnnnnnnnnnnnnnnnnnnnnnnnnnnnnnnnnnnnnnncagccaattgccaattgctctccaggtagaaatggggcttcatgaaccctttctccatccgtgctgaaattctgaccatctggctcttgtgcaggcagccacacccactgtgagttcatttgtgtgatggccctgtcctggatggaaatcagtttcacaaccattctcctcaccctctgtctcctgcaatcttttcattccctcttttgcaacgatcccgagcctctcaggggcggggtgcagacaccactttagagctgaggacagctctcatcctcatacctctgtttctatctagagtgctagattgcagatgtgtggtacagcatctgacttacatgatgctggaggtgaaattaaaggtgttgtgcatgctaggtgagaactctaccaactgagctacatctgtctcccagggctcaagttttcttttcatttacttataaaatactctaactgtttgaattgctttgatataaatgagtacactgttggcctaacagtttttgtttccctttgataacattatggttttcgtctgtttggtaagtattggttgtgccattggtatataggattatcctggctaaagattgaacagtgaatccagcttggtggtacatacttgtaatcttagcatttgggtaactgaggaaaattcaaagccaatctgggctacatagaaagactgtttcagggataaaagaatttagcagtgaaatgaacataacagcaaacaataaaaaacattttcaagcacaagaaaacaaatcaggctggagagagaactcagaggttaagagcactggctgctctttcagaggttctgagttcaattcccagcaaccacatcgtggctcacagccatctgtaatgagatctggtgccctcttctgatgtgcaggcagaacactgtatacataataaataaatctttttaaaaaaagaaaaagaagcttctcagtttcaggaggtcccatttattaattgtggatctcagtgtctgagctactggtgttatgttcaggaagtggtctcctgnnnnnnnnnnnnnnnnnnnnnnnnnnnnnngggtatttcctattttctcttctaataagttcagtgtggctgggtttatgttgaggtctttgatccatttggacttaagttttgagcatgtcgatagacatggatctatctgcagtcttctacatgccagcatccagttatgtcagcaccattttttgaggatgctttctttattccattgtatagctttggcttctttgtccaaaattaggcgttcataggtgtgcagtttaatatcagggttttcaactcgatttcattggtctacctgtctatttttgtgccaataccaagctgttttcaggactatagcgctaatagagcttgaaatccaggatggtgatgcctctggaagttcttttattgtacaggcttgttttggctatcctgggtcttttgtttttccatataaagttagggagtggcactattaggaggtgtggccttgttggagtaggcatggctttgttagaagaggtatcttcctatggggtgggttttgaggtctcatatgctcaagctacactcagtgtgtcccacatttgcttctgctatgggcaaggaagcttctgcagcagtggtgtccatgattgcagactcataactgaggatgggagacattgaagcaacttctctcccaccagcactgccccccccccaaaaaaaagagacagttaagacagtgagctgttgaaaagagttctttaaaatttggtaaagatcctgaagtgtagctcttcacagttgatggcttatggtggaggggtgggaaaggactcgattttctttaagggactggccactgttagtttgactaggctccagtgactatataggcaacacaaattgaacttggtgtttttgtttttgtttttttggggggagggcagcgggctcagatcatagacatcaacatagtttctggcagcagcacagatcatgggcatcagcgttgcctccagtggcatcatggaccatggaagtctttcaaggagacttgatccagaaaaggaaccattcttcatcttgggtatcttgttgctcagagtcagggtgatggtgaagttgggcagcattaccggggacaagacctgtgctggctgcaggcttgtgtactcccccccgccctggtaccagcctccccccgggtaccccaggcatgagcatcgtgtttccagcctgtggatactatggccctgtgctctccttgtgtcaaggtgagcagccattccatgctgcaggtggcaccagcctagcagacagcaatgaggcaatgtagacaggtgggtggcctgagcctcgcagaggcccaaacaccagtcctacatggcagcaatgtgctcctttgtctgctctagggacagactctcattcctgttgctgccattgcatctccaaacctgcttctctcagtcatctttctgtctctccactgcacattcatttactaaagtgacatttcaatctgccgnnnnnnnnnnngttactttgcccaaacagctttacatgcagacacttaatgcattgagtcattgaactggttcaaggtttctgaggcaccataaatactggaatattggtgagactcatccctggtatcctgttgtcaagagtcagggagattgtacagctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaacataattaaataggatatttttgcccccacatagcatatttatattttttcatataattagtgtttatttgtaccaccctgcctattaaccctaatttgttttgggatgaggagttcagacttttggttggttggtcagttggttggttggtgggttgcttggatgatttagtttggggtttattgagaccaagtcttaccaaggagctcaggatggcctacaatacactgtcccccttgtctctacctcccaagagttggggctataaacatgtacctccatgctcagatgaacccgaatttgtcagtccctgtgaaatttgtgctaactatctttatggcagtaccgttttccagttttaaattacattatttgggggttttcacacatgccatggtgcacatcagaaaccagagggcagcgtttgggactcagccttctcacttcagcaggcttggaggcaagctccttttcccacgcactattttcaaggtctctgtgccaaagatctacccttgggtctttttacatttttctctgttaatttaagttctatctattgtaagctatttgtgccatgtagtttttatgagaataagctgtagaaattacattttgtgttgtattgagcagttaagcggtagcacttgagagtaaagtctgttgagagctgataaagggcatatggaggtattcgtgtcctaaagggaagcaggtcctggtgtggtgtgaaaccaaggagtcaaggacagttttcccaggatttggggctctgctcagcaaggttggaaggaagagaattgttaaaaggaaaggacatcacttctggagtactttgtatgattttcttgggtcttgggccagaattgaaagaaaaaggagcacaaaaggtatggaagagctaatgtaacaggagatagacattcacacattagatggaaatgtttcagatttctgaggtccaggactagagagatggctcagctgttaaaagcactggctgcccttccagaggacctgggtttagttcccagcatcctcatggcagcttacagttgtctgtaactccagttccagaggctccagtaccctcacacagacatacatgcaggcagaacacggatgcacataaaagaaaaatttctaaaacaaacaagttttttcataaaacatcttataggccaccatttcatagaaacacaatcatataattttagagcccagaataatcatatcctacctccctgacacaaaagagccttaagtttagaaagacctccctttaaaaacgtaacaatcaagcatggagagatggtttagtgattaagagcacatattattgcttttgcagaggacccagcgtggtccctgacctcagttttttaaaagtattaattgtggggatggttgtgactatccaaaatccattagattgactgctttgatgggtaaattaaatgtcatctaaaattataactttaagcatattttgaaaagaattggttgaaagaactgagtgtggtggcacgggtgatttcaaggccagaccagagagcaggagactgaagaagaaacaagggaaggagagaggaaaacggctactgctagccatttgtgcagaacgattcactctttctggttccttgtttcgttttgctttgctttttgtcgttgttttggagaaggttggtgttttgggggggttttgtttgtttgtttgtttgttttgtgattgggtttttctatatagccctggctgttctggaactcactctgtagaacaggctggcctcaaactcacagatcctcctgcctcttgtgctgggattacaggcgtgtgccaccaacacccagaccattctttctgttttgtctttttatttggctgattttcttaatctatattgtctccatatatttatttgccagtcgctgggtgagtcgaagtgccacagcacagcgccggaaagagcgccttcgccagcattctgaacacattggactggacaatgacatacgggaggtatgtggtcggactgcctgggatgccacaatgcagagatcagaaaactcacccaggaggtgttaggatctttcaaggtcttttaaaaacagttcctcttattttaaaatactatttttatactaaaatgtagcagaaagcatttttccagtcttgtccttttattcatctacaatagggctttatgtctgtgtattaaatctaatagatgctttatttagggtaaacattttgttgttgttggggttttgttgttgttgttttttgagacagggtttctctgtgtggctttggagcctgtcctggcactcactctgtggaccaagctggcctccgaactcagagagacccacctgcctctgcctcccgagtgctgggattaaaggcatgctttatttagggtaaacttttggtcagtaggtctcctgaaggtagaaacattgagatacacatatatctaagtttcacatattatttaagataaagtaacacattctttggcttttggcttttggcttttggattgctgatgccattttttagaggcaccagagctgttttttagactaaaatctatatgctttatttgtattcattgaaaataaaattcaaattacgttttagtaattatattttatttcttgtgataaaaagaaaagttggaacaaaaatcttcataactgttttgtaaactcagatgggtagaaatacaatagaaaacaccattccagaccgaagcctttcttcttgttcattgtctttccttcactcccctccccatgctgtggtcctatcatgtgcatgcaggttttgcttctctttcttttttccccccttgtttacttctctgtcattgaaatgtcgtcatcatcttagccttccgggggacttttggtctgtcagaactccatggcattctgggagtgggatcagggcccaactcctcccgcacggcttcctaaaaagtccttctctgagtgctgcctggtatgtccttggccttgaaagtgcttcacaagatattcctgaatcttgctacttggtgtttcttgaatggcccacacctatgagtgcatgtagcatgttttgctctttgtttgctgcctgtttgtgctggcatgtgcttgcataagtaattttatgctgttgacagtaaaactgacattcaagtcctgagtcattgaggggtatgtgtgtatgtatacatgtgtatatatgtatgtatatatgtatgaagaacctcgataacaaattacttttcttttaaatgggagagaaatgtatgataaatcctttatattttaaggatttcttttcacaagtgcagaagtagctgaatatcagcttttattagatatttgtcttcataccattttaatttacttttcctggtctacattttgtttcagaaaactcactcatcatcatagaatactagtgctaagaggaggaacctttgaggttgtcttgtctagcttgacattttagctgacaagcaagaaatttgcccacagttaaatggacatacacagcagagctgagcctgtagcacaggactcctaatgtccaggctcaagtgtcttcccactaatcatgctgtaaccactgctcacctgaggacacaaatagtctaggactctggcttaactttttctctgttatgtcattagtttacatttacagcagtcttcctttccagtgagttagcaccaactaaaaggtcagaatataatataatatatattattatgtaatatataatataataagctattacaaaattgtggggaaggctatattaaagagcaattatttctaaaaatcagtgtttattgaacaagattgcaatttaatacatatttcctagtggcttattgcttctttttttcggtggggggcggtttctgggtttgtgtacttgttttgtttttattttgagacagggtatcaaccatgtaactctggctagcctggaactcacagagattggtatgcccctgccccccaagatctgggattaaaggtgtgcaccactacacccaactgttttattgtttttgctgtgtgtatgggtgttcacatctgcctgtctgtctgtctgaggatgtgaatgccacctgagtataatgccctcagagtacattgcatctcttgtagctagagttacagttgcttgtgaaccgcctgaagtgggtgctaggaaccaaattcaggtcctctccaagagtaataacctccgtttgcttttgtattgagacagggtccgtgtatcctagcctgacataaactggcatgtatttaaggctgatcttgaacttctgatcctccttttccacccccaaagtactgggattaaagacagcatcactatacccagtttggtttgtttttaataataataataataataataataatattgttaattgcagtggtggtggttttatgaggcagggtctcactatggacatgtgaccatcttgaagctccctgtgtagaccaggcaggcctccaatttaacagaaatcagcttaccttggcctccctagtgctgggattaaaggtgtataccacctcacctggcctttatatttcttttaaattatgttcatgtgtgtggggctatgtgtacttaagtacaggtgcctgtggaagccagagacatcacatactcctagagctggagttaactgagctccctgatgtgggtgctggaaaccgaactcaagtcccctgcaaaatcagcacacactcgattcctctgagcatctgtccaaccccaccacacccagtgtttatatggtgctgggaattaaaccagggttttgtatatgatagtcaggcactctacagttgaactatatccccagtgggaaagctctttcaacattaaaaatttattttcacccatctttatatctagcttttaattctgtccccaaataacaatagaaaatgaaaatgtaatccccatatcgatgctgccttgtagctcagattgatttttctaaaagtgcttttatttcctacatttacttatttgaaaattgacttttgacaggtggtgtagcatgcctttaatcccaatgctcaggaggcagaggcaggtctctgtgagttctaggccagcctattctcagaaagtctcaggacaggctccaaagctacacagagaaacactgtcttgaaaacaaaaaaagaacgggttcctgtgcccactgctacatttaatgtccctgctgataatagttttctcattctcagtttttcatttttatttttcctttgaatactatttatttaaagtggaaacatacatgtaagtgctgaagtaactgttacatggagaactcatttgctgtttcagtggttccttaaaattattagactgaaaaaaattattagaccgagaacaagccatatcatcttgttaatgttaccttttgtcatgaacattgagagaaactaatcacttggtcgttaatcagtggaacttttggcagctttagtgggtctattttcttccaaaggggaaacagattctcttacatttaaagagttcaaaggattttacacatcttattttatagtatcaaattctccccttaagataataagaatagatttacacctatgcccgtgaatgtgtcaattcactagcacgcagtctccctcaacaaaatgctagttttgctgtacgatttagagcagttcttcaaaatgtagtcttaagacacacatcttttggagattctgccttgtaatcttcatgccaagcacttgatgaggttcttcaggcagtggagaagcacagagaacatagttctgtgctgatgaggtgtgtgggggcctcttttgagatgtgctcttgagtaacctagcctgacctcaaacttttctatgtgaccttgaaaactgtctctctctctctctctctctctctctctgtgtgtgtgtgtgtgtgtgtgtgtgtgtgtgtgtgtgtgtgtgtgtgtgtgtgtgtgtttgttaccacaaagtcagcagaggactctgggcataaaagtaaggattgtagaacaaggaaaggaaggaagggttttttgttttgtttttcattttttggtgcaagggaaggttttgtgtgaacatctcagtagagtcatcccagctcccatacctggagcccatcatgattttcagtcttttctgtgaactgtatagcatggaccatacagtgacatgcagcaacattagacattcgatgatacgatcattagctacaacacaattttggtactatttaaagttaattagagccaaggatttggctggagagcagtgccccagatgattgacagacttgaagtctctgttgagagaagtagaacagaggaagccagtgacctgagaaccactctgtttctgtggaacctcagactagactagacacctaatttttttttgctcttatcttgatcccaactaatcataaggttggtggccccactaaaaagactaaactcaatgaaactcctgattttgaatgaatttcaacttaatgcttctgtcacagcccttttcacaagagttaactggtttggggaggaatacacgtgttctctgccttctatcaatcaccgaaatcttaattgctgttgcccacgtacacttacggccttttgtacaacctgcctgttgtatttattcatataagttttaagtagaaaataatatgtgatgtttatacatttaaaatactcctgatttttagaaatacatgcaagaggcacgaagcttaggaaaaaacatgagacaaccaaaactgtcagatctctcacctgctgtgattgcacagaccaactggaaatttgtagaaggcttattgaaagaatgcagaatgaaggtatgtatcctgcccccagacagtgtgcattcgtatgtataccctgtgtggatctaagacgaggtaagtcaactcccatttgtgcctgtaacttctctgaaaaaaaaaaaagttcattatttcatttttttatgagtatgggtgttttgcctgtatccatgtctgtgtgccacatgtgggcagtgcccatgaaggccaaaagaggacatcagatcctctgggattggcattacagatggttatgagctaccgtgtgggtgttgggaatcaaacccaggtcttctgcaggaccagccagtgctgttaacccctgagtcacctctccaagcttcaaaagaaacattttttgtaacatagacctgataatgctcttcactgaagtcatgaacctccatgaagtctcacagcccacagcatcaatgacatgggagcattgcatagtttttcatatttttttaactattgtatgatgtatggtgtgtgtgtgtaggcacacatgtgcaagtcagaggacagcttagcaaagtcagttcttaccatctacctccttttaggcagcgttttttttgtttttcgtttgtttgtttttttgtttgtttgtttgttgccatcactatggctgtttgaaaatggcaggcccatgaacttcatctcaaatctcacatagtagcgttgagattgggggcatgtgccgccttacccagcttttacatggttcccgggatctgaactcaggtggtcaggcttgtacagcaagcacttttacttacaaactatctccctagcccttagctggagtcttcctcttcagtatgatgtgaagccattcatgagttatataaagaatgttgctctcttatgtgaaaagcagtgtgtatacctgtgtaaagccttgcttgtgcccatacatgttatcacatgtgcccaagggaaaggatcttaactatggtataggtcagtgagtattaaatatcattcttctctcacagaactgcctttatacagggtagccatatgaatgaaaaacctcagtaacttgtgagcatattcaataaaagtactgttttcagtgtcagtgtgtacaggtaattagacaaggtactacctagaggagctgtagctttctcactttgcctgtgcaagactagctaaggtagatgtgaattaatttacctgaaactggttttcattttctgatacatccttgtgagcaagtaagagaaaaaagggggagatggtgagaaccctagttcactcacaaactaggaagttctcaaaaaaaaaaaaaaaaaaaagggaagaaagaaaaccatagagctactcatttctattgtggctttgggttaagtacagaaagctttagtgtgtcaagatgccagagtcagtaaaggtcagcttgtagtgacggaatgaggttcttgtgtcagaagatgccttttctaaattcaagacaattccagaagctttaggacaattatactgttacagaagtcaatagattatgggtttttttttttttcaacattaccatgccttacaaatactattgtttcattagtgccctaacatttctctgaagtaatagtaaaatatagaagatattactccaaccagctgaccaccagattaagatattttctccatggtgcctgaaatctgttatcagaattgtaatgaagggaagcagatctccctaaactagtaattgatttccttggttttgagtttccttgctgtggtaacttatgaccggtcatattgttttcagacaaaacgcatgttggtagaaaagatggggcatgaagcagtagaactgggccatggagaagccaacatcactggcttggaagagaacaccttgatcgccagcctctgtgacctactggagaggatatggagccatggcttacaggtcaagcaggtaaccaactcaagaggcaccggtggcacggctgattcaagggcttattcatgccaagggactggactgttcagggtggcactcgggaagcaaagcaggtggatctctgtgactttgaggctagcctggtctacagagtgagaccctatcctaaaataaggaaagaaggccaggtggcggcggcggcgcacacctttaatctcagcactcgggaggcagagacaggcaacctggtctacagagctagctccatgatagccagggttacatagagaccttgtctcaaagaaaaaaagggaaggaaggaaagaagcaaagatgaaggatgaggctggcaagactgctcagcaccaagcctgacaatatgagtttgatctctggaacccacctcatagaagggaaagagacattcacacgaatgagaaatgtgacaagaaaaagaccccacaagataatgaaatatatatcacagactgtttggttccagcaaaagaaacaatctgggctagatgtggtagcacacacctttaatctcagtgcttgggaggcagagagaaaggtggttttgatgagaatattttgtgataaatgtttctttaaagtgaacgttttgtgtttcttgtgctttcaggggaagtctgccttgtggtcacatttaattcagtttcaggaccgagaggagaagcaagagcacctcacagattcaccaggtaagaaggcgttggagtaagatagattgcttcaagtctcgtgtatcctgggctaaccctgtactcttgatctttctgccttcacctccgaagtgctaggattataggcatggaccaccaacctagcttgagatagattggtttgatagagtgggcagtatgaggcaaaaagaagaatcagtgtaggtgggtacatctcaatctaaaatttacccacgttgccaataaggataaagcagaaggagcaataatacaagatattaatctaaggaagctcacttgaccctatcttctgtcctctcactgtaagacagagaaaatgatagtagctatccagagtgatcacgttgatataaaggaacaaacacaattaattgtgaagaacattacaggtatatggtatatactgttgttattgttattttatcattattgttattgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaacaaagaaaaaccctgcctcgaaaaaaaaaaaaaaaaaaaaaaaagaaaaagttttgtgaccttcaataatatctttttttttttaattggtttttcatgacagggattctctgtgtagtcctgtctgtcctggagctcacgctgtagaccaggctggccacgaactcagagatctgccagcctcttcctcccaagtgctaggattaaaggcatgtgccgccaccaccctgcaataatcttaatatcttctaatacatcttatttaatttttttaatgtgggcatgtgcatgtggaggtcaaatgacagcttgcaggtgtcatttgtctccttccactttgtgggaactgagaatttggttctggttgctcctcggtttggtggtgggtgcctttatcactgctctcactatccttcctttctttctttctttctttctttctttctttctttctttctttctttctttctttcataatgtcaggatcaaatcctgggccttgtatttataaataaactttcaggaaaaattacatattcatctccaagactatttaagagtcagagtctttggcttggctcctttccttctttttgagatagggatcttacttggatgctcaggctgacctcaaactttgtgtggattccaccttagctccacctgtagctgggactacaggcgtgtatcaccacactcaacttaggagacagattcttcagtttatannnnnnnnnnggcataattctcctgctaatcagaattatacaggattccttatgtcaaataatacaactattacattattttttttacctcaaagagtttgtttgttttttttattggcagtgctgagggtcagacccagggcatcagccactgagtcatgtccacagcccagagcttggttttctttatgtaagataaccatctatttcataaaatataaaattaacagtaggaagttaacagaaataaaatgtttgggtgggatagggcagagcttggctgtaatctcagtactcagnnnnnnnnnnnnnnnnnnnnnnnnnnnnnnnnnnnnnnnnnnncttatccccccaaaaaaaaacctgaaagggaataatgcaagattttatactgaattagccatttaggaaccactttttaaattataaattctttaaaaaattcaaaaataaaagatttttttttaaaaaaaaatgtttttgagacatgatctcactgtgtagctctggctgacctggaacccaccatgtagaccaagctggccttgacctcacagagatccccctgcctctgccttcagaatgctgggatcaaagacattggccactatactcagctgtaagagtctgtggtatggctcagagagcaaagattcctctgccaactctgaaaacctgggcttgatccccagagttcatatggtaggagaaaatgccataaaattaccttttgacctccacctggagaccatagaacgtacgtgtgtgtgtgtgtgtgtgtgtgtgtgtgtgtgtgtgtgtgtgtgtgtgtgtgttattcacataaactaaccaccaacttaataagtaaaactaagtaaaacatagccggttaaggatgtatctcagtggaagaatactcactagcaagtgtgaaaccctgagttcaatccccagtactgaaaaatagatagatagatagatagatagatagatagatagatagatagatagaacaaatgaaagaagggatacccttgtattcatctccaattccttttcctatccctacccaaggtagcattatcctacagagtttacttgtaaaaaaaaaaaaatcattttcaatgtatcttataagataacaggaatatggatttgatactacattgccctggaactcctcaatagcttgtcggtgtcctaaggcctttgccataactatatttatactaagttagatttaggtctctaatacccacctcttcttccatttttgctatatagaaagtaaaagtacattggtctatgtcctgtatctaacaggaattgtagccattggtaatgaaaaccacgtaagaaagatagcttatctaaatttcatttgattataactagaaggccagtaagtggttagagaaagcagagttgagagtagtggtcaccccaaccctatggtaagggtcaagagttgcaggccatccctggtatgtgtattagaccctgtctcaaaagagaataagttcttaagaagtagctattcatggggtaaaatgttggaaagccaagttcaattaagatgggacagatgcattcaactctgatgcccagaaaggcacatgagaatgttcagctgctgttgggcaacacacgcagctcttgtggttttcactggccaaaagttgagtggttcagttagaaatcaaactcctgactgtcttcagtggcctccagcaaattctaaagtgcaagataaatgaaagtgtgtcgaagatctatacagttacagtctctgccacactgtcaaatcgatgaagggctaatgatgtaagagcaaacagtattttagtgttctcagtaagattaatgacagccatgtaacttttttctttttcagagtctcattataaggctcttgtctggcctggaactccctatgtagatctggctgtcttcaaccttacagagatctgataacctctgcttccccaagtgatgggattaaaggcaggcaccagcacttgcccagcataactaattttttttttaattatatgattgtatgtgtgtaaatgtctttggaggccagaagagggcatcatgactcctaaacatatagctacaggtggatatgggctgcccaacatgagtgatgggaccaaatttggagtcctttgcaagggcaatacatactgataaagctgagccatctcaccagccctaagccgtagagaatttgaagtctgtgtttattgtttcaatggaaaggaggcagaggcaggcgaatcttggtgagtttgaggtcagcctggtctacaaattgagttccaggacggccaggaccattacacagaaaaacctgtcttgaaaaacaaaaacaaaagttttaaacttaaaaatgcatggcagagtaacatcacctacttcagggctgccggggaacagaggtaggacaaactataccattccattgcatgctgtctgtgacctgcttgatccctgtaggcccaagacagagtacacccttaaagggcacacacactcagtgacctacttgatcaatgtgggccccagattctcatctctgccacctcccaatgccgtcagactgtaagtccatcagtgaatctttgtactgattaggctagagtccagatgattcagtcacctcccaaatgttgtgccacgtgtgaacattatattaggaaccaaatcgtaaacacagttttgggaggtgcatttcccatccacattaacagtccctttccctataagacactgttgtggaagctgcagctgtactaaagactctatcttcattgcttaatttattggttttggtgagaggggttgtacccaggcctcacgagcactgtatcgctgagctgtacctctaggccacctgctgactatgggcatctcctctggctccttgtttccctctagacaacttgctgactgtagtgtcaactcttttcctctgcttcatagttttctcccgcttctcagggttttgttttgaggttattattctcttcagttttgtttgttgaggcagaatttcccatcgacaaagatgaccttgaactcctgatcctgctgcctccactttgcaaatgctggaatacaggttgtgtgccactatattccttactatttgtgtgggtgcatttatgttgccatgtggaatgaagagtcattctcgaagccatttgactttccacccccgaagaatggcacactttaataacacacttaaactaagatggtcttgataggaagataaacatatttcctgcaggtgtctaagacaatttcctcactgtgcattacttccctgagtatccaaaagagattagtctttaaagtcccagtttgaaaattaccttccctaagccagatgttgtggcacactcacttaatcccagcacttggaaggaagaagcaggtggatccatgtgagttcaagggtggcctggtctacagagcgagttctaggatagtcaggctatgtagagagaccctgtctcagaggaagaaaatgaaaaaagttccctccctaatctgcctcctgaccgccatctagagcctccgtgtcagtcccataagtgatcatttatatctactagacacgagtccagctttttcaccaaacaccaaaaacataaagatctaatactctgagattttcactgacccttccttggcagcatgggcaggagagaagcatcttccagtatcacaccctggcttgtcaacatcagtggatctaaaacctgagaaaaaaatagctatgatataaagcaaaatccactttctaagttccatcagtatatttgctaaaggtggtgcttcagttcagtttccatttacagaagagaaaatggaaatgaagaaggggtgcaaaatgccatcgcatctcaccaaaagtgagaccaaacatctgtctccacttcatagccagtggctgtgtgctcgatgcttcctgtaagagtcattttccttcttttataaacattagctgtggaactggagagagagctcagtggttcagagcagttgttgctcttgtagaggacctggatttgatttccaggatccacctgatggttcccagccatccttatctccagtgccaggggacttgataccctcttctcctgtccatggaccaaacacatgccaaacatgcttgtggtatttaaacgttaatgtgaaataaacatggcatttaatttattaaaaattactcaccgagcatgattgtacatatctttaatcttagcatttgagaggccagtagatccatgtgaattgagccatcctagactacatagtgagttccagaacagtcaagtacagggtgcaaacctgtctcaaaattaaaaagaaaaaagaagaaaaggaaagaaaaccattcatgtatcttatgcttttgaaagccaatttaaataactcactttgcatgatgtgcataatgtagttaggattctgaactttgaaggaggaatttaccagcctaaagagccagagcagttatattaaatgcaaaataataataaaatttaataaaagaaaaaagctgggcatggtggcacacccttttaaacctaacccttggaaggcagaggcaggcctggtctaaaaagcaagttccagaacagccagggccattacacagagaaaccttatctcaaaaaaaaaaaaaaaaagaaaagacaaaaaagccttccaaagtttaaacattaaatgtttttctgtgccaatgatgttctgggtccaatccccagaatcacatgaacagggtgtagtatcacatgcatgttatcctagcattcaggataagaaaacagcagtgggtacatgaggcaaaaagccataaataggtttccagttcataaatctgaagatgaaggctcacatacctcatagcttaacttctcaacattgcctttgagtaattacccagcacgatgagaacaaatgaatagctaaatggctggccctcatggccatattttacatatattgcattatttagaagatgtactttcataaaatacttgttttaaatttccaaatatagccacagcttgtttagaaagaacatacctgtttactgtattaataaattattgatactaaatggtcagccctaaagacatacacacaagtaacagtgtgcagacagagcaggttgtcttatgtgtttagaaatatatatacatacacatattcaatgacaaagaaaaggagaccatgtggggaatggagggtacatatgggagggcttagggggaggaaagggaagagggaaatgatatattattattataatctcagaaattctttttttgggttttttgagacaggatttctctgtatgtagcattgtctgtcctggaacttgctctgtagaccaggctggcctcgaactctcggagatcctcctgtctctgcctcccaagttctgggattaaaggtgtgcaccaccatcaccacccagaaatctcagaatttttaaaaaaattattttaagaatgtatcaataggccaaacatggtgatacaccctttcaatcccaacattggggaggcagaggcagtggagctctgtgagttcaaggccagccagggttacacagaaagacctgttttgaaaaaaaaatttttaagtataaatttttactgttattttcctaatactttgctaatatttttctacatagttgcccttggaccagaaagaagaaaatctgactcaggagttatgttaccaacactcagggtctcccttattcaagacatgaggtatttgttacacgttaacgaatgtcggtaactatgaggtgtagctttcacctgagttgctcaagtgattataaccataccttttgtttacatatcctgaagaaagtattttcataattataaatatgggttttttaatttatttaattttagtttatattatgagtattagtgttggacctacatttacacatacacaaaccatatgcgtgcctggtgcccacagagttcagaggagagggaactagatctcttgaaaccagagttagggatggttgcaagctaccatctgggcactgaaaactgagcctgagtgaagagcaataagtgtttttaactgcacagccatctctccagcctacattttaattgcttactattgtgctgttttgttgttggctttttttttttttttttttacattaaatagaaaggggcagttggggaagagctttctataaaacagctataaactgtaatttctctttgatgcatctcttaaatgcatgctatctatagatatgcagacaaaaaatatagatgacaacaggtggcttagcagaaaaaatgctctcagaatgatacaatttttctttttatgtttatttgtttgtttttccagacagggtttctttgtggaaccctggctgtcctgagactcactctatagatcaggttggcctccaactcagagatcaacctgccaagttctgggactaaaggtgtgtgtgccaccactgcctaataagatacagctttaaaaatacaaatattaaaattaacatttcttgccagggagtggtggcacatgcctttaatcccagcacctgggaggcagaggcaagtggaaggtagaggaggcaggcaggtaggtctctgtgagttcaaggccaaccatggctgttacaatacagaggaactctgtctcaaagcaaaacaaacaaaaaagaatgaatggaaaaggttacacttttttcttataaacattttaagcacaatatttagtcactatttaagatatcagagttcaaaatgtgtgtacataaaatataaaataactgtaacacttatgactttttgttccggggctagggagatggctcagcagttaagagcattggctggtattctagaattgagcccagattcaattcccagaactcagatggcagctcacaactatctataactgtagttctaagggatcctcacacagacatacatgcttgcaaaacaccaatgcacataaaaataaattttgaaaaaagaaaaagaaaagaaggggaaaaaaagacttgtgtcttttgtggtggcgtgagtctttgacctcaacacttggaagcagaagcagaggatctctgtgagtttgagaccagcctggtctatataatgagttccaggatagccaaggctgaattaaagagactctgtcttaaaacagacaattacaactttcctttaaatgtgtattttgttggtatagtttgtatgtgtgttcatatatgtgtgagctcgtgcgtgcgtgcgtgcgtgcgtgcgtgcaggnnnnnnnnnnnnnnnnnnnnnnnnccaaaggacaacttatgtcttttcttaagtgctgtccacattggtttttgatacaagttctttcattgccatagacttggccaattgggctagttgggctagttagaaagctcctcctatctctgtctcccaagcacaagaattataagcacctcattttatgttttgtgtggtgtgtgtgtgtgtgtgtgtgtgtgtgtgtgtgtgtgtgtgtgtgtgtgtgtgtgtgtatatggatgtttctctccctcccaccagttccaagtacccaaattaccacacagaaacatattacttataaatactcaactgatagctcaggcttattactcactaactcttacacttaaattaacccataactcttatcaatgtttagccatgtggcttggtaccttttctcaatatggcattcttatcttgtttctctgcatttgccagtgactttcttgactctgcccctcctcatcttagtctggctctcacactcaacctcttcctgcccagctatcaaccaatcagcttttatttaataataagtataatccacggtgtgtgtgtgtgtgtgtgtgtgtgtgtgtgtgtgttgtaatgagtcacactaacaaagacttttcactagagttagtttttactatttaccttgtcttctttttctgatcttccctttctctgctgggaggaaaattgcttaagaaaataaattattcatttctcctggatccagcagtgacttctatatagaattctaatttatacatatatattgcattcacttgctattggtcacacaattttctaagtcccttttcacattttaagacttatcaccactttgccaggtgtggtgccacagcagcaggtgaatttctatgagttctaggctagtctgatctgcatagcaagtactaagacagccaggactacataaacagaccctgtctcccaaacacagacaaataaatcaacatagtactgcttatctcctctaatactgtataaagtaactaaagcagttacttcaaataaaccaggcattggtggtgcacgcctttaaccccagcactctggaagtagaggcaggcagatctcttgagttagaggcccacctggtctacaaagagttccaggacaggcaaggctatacagagaaaccctttctcaaaaaacaaaacaagacaaacaaaaaaatatatcacccaagccagtcgtggtgcaatatgcatttaatcccagctcttaggaggcaaatggatcagtgtgttggaggccaacctggtctgtatgatgagttccaggccagccatggctacatagcaagactctgtctcaaaaactaaacaacaactacaaccaaaagaaaaaaaaaaaaaagagggctgaagagatggctcagaggttaagagcactgactgctcttccagaggtcctgagttcaattcccagcaaccacatggtggctcacaaccatccattatgagatctgatgccctcttctggtgtgaagatatacatggaagcagaatgttgtatacataataaataaaatcttaaaaaaaaaaaaaaggacattgtgtattacccatttcttcatctaaatacaaaaacttttcttggtccagcattgttaatactttttaagctcttttccagcttaaagttatccttaaaaacctctcctagtctactgtgactggggcgaaagagcaaactaagcacatccttgctaatttcaatagttaccagttttgttttggtttttttgtgaaaacatgaatctagatggcgtggttgctctcttagactactgttgagatggcgtgattctataagtgactttctttaaggataatttaggaatgggaaaatgttaacaaattggaaagttatttttgatctgtcaccttcaccatgacttgctattgcttgtcatccatgcaacaccaggacttaggacaaagaggactaagctgggtggtgatggcaccatgcctttatttccatcatttgggaggcagaagcaggttgatctctctgagttcacaggccagcctggtctacagagtgagttccaggacagccagggctacagagaaaccatgtatcaaaccacacttatctcctccacaaaaaaaaaaaaaaaagacaaaggggactgatgtcattttgagtttttattttgactgtgatttatttgaatcagatgtattattttaagggaaaaaaaacatttcatataggttgtctaaaaacaagatgtatttaaatgcaaaaaaaatttctttcttgttggtactgatttttaggcatattcagaacatgagtgagatcaagactgatgttggccgagcccgggcatggataagattgtctctagaaaagaagcttttatcacagcacctcaagcagctgctctctaaccaactgctcaccaagtaagactcttgtctctcacgatatttgttcctgtgattcgtgcttacaaaggaaattaagtaagctgatgaactagcaccttcatcatgaatcctgattaatgagcacatacatttttgtataacaggtgtgcttcagaaaataacctttgtgaggctggactcagaggcactggctgagttcagttcccagcaaccacgtggtggctcacaaccatctctactgggatctggggccctcttctggtatgcaaccagaaccttgtatacattaataaatcttcaaaaaagaaagaaagaaagacctttgtagaatatttgatcatttctgagagggcacaccagatttaatagctaagaccagattactgttctgtaatcagaaaaataaatgctcactagtccacacaagctgacactaggttgaacttacattagcttcattgcataaaactcagcaagaagttgctgcagagcactaagaggcaggtggatctctgtgagtttgagggcagcctagtcctcaaagcgagttccatgacagatgggtctacaccgaggaactctgtaagaaaaggaaaaaagaaaagaaaagaaaaaagttggtgcaagatatttgatcacactgtgaacactgagattgtgttatttactggaaaaccctgtttctgcctgtagcatgcacctttaatccaagagctttctgcttgaatattgtaagcaggattaaacagaatcaaccttatgtcaagaggtggagcaagcaaccagtggacaggaaagaaccatagagaatgagggagttggaaggatggggagagatgtgcaggaagtagaaaggagggacatcccattggaggagtttattttttgttttgttttaggtagtgtaagagaaagctgtctttctgggacagcagtggaggaggaaggccagctgggtgctttctctgcctttctgagctagcagagtttcaccccagcatgtggctcctgactttttattgctgaaatggaacaatagaaatttagtttaaaacaagtagactagggctggagagatggctcagtgtttaagagcactgcctgctcgtccaaagatcctgagttcaattcccagcaaccacatggtggctcacaaccatctgtaatgaaatctggtgccctcttctggcctgcagacaaacatgcaggcagaacactgtgtacataataagtaaataaatgtttaaaaacacaaaacaaaacaagtagattagaagaacagaaagatggagtctttctaatagacttttaatagtttagattcagggaaccagttgcttacaagtcagttaattgttacccagtcagatagtttctgtccttacccaaaagaaacaaaaaacaaaaagcatttatttttttattctggagctacataaagtctcactatgtagttctagctgccctgaatctcactatgtagaccaagctggcctcaaactcatggagatttacctgcttctgcctcctgagtgatgggattaaagatgtgtgcctccaagcctggcaagaaatccttctaaatgataggacattagaacttacttgaaagctaagcagttagaattctcaagagtaaaggtgtggtagcacctttaatcccagcttggcgtagtgtgtctcaggagtggtgaatccccagagctcatttgacctgccattctagctgaaccaatgaactccaggtctgatgagaaacgctttcaagaatgaatgaatgagccgtaccttggtggctcacacctttaatcccagcactcgggaggcagaggcagatggatctctgtaagtttgagaccagcctggtctacaagagctagttccaagacagcctccaaagccacagagaaaccttgtctcgaaaaaccaaaaaccaaaaacaacaacaacaacaacaacaagaatgaatgaatgaatgaatgaatgaatgaatgaatgaggtagaaggggctggagggatggctcagcacttaagagtactgggtgctcttccagcatacctgagttatattcctggcacccacttgattaaatgatagtgttgtttgtttgtttgtttgtttgacatgtatgggtgttttatctgtatacgtgtatgtcccacaagtgtacagtgccataagagagcgcccagtcccctaggactggaattacagttatgaaataccgtgtttgtgctagggaatcaaatctatgtcttctgggaaagcagccagtgctgttaatcactgtgtgctctctctctagcccatgtttgaggggattttttgtttgattgattgatctttagtttgtggggagggggtttgttttggggggttttgtgtattttttttttcttttgctcaaatgcatgtttacaagagccaccatgaatgtcagtgtgtggaaatcaaaggacaacctgtgggtgttgtcagatgttacattctccttccccacatgggtctccgggatttactcatggtggtggtgagagttggcagcaagtgcctttactccctgagcgggtgcattgactcagagggtattaattttaagtcatgattcttaagaatgagaactgtgactgctgttttgtgcctgtgttaacctttctcaggaagctgtacaagcgttacgcttttctgcgctgtgaagaagaaagagagcagttcctctaccatctgctctcactcaatgccgtggactatttctgctttaccagtgtgttcaccactattagtaagtgtggagagttgacttttaagtgaacaatctccaggtgagcaggcatgggtggccaatagctgtaatcccaacgacactcagaaagctgaaagaagaaaattgccagttcagaaccagtgagtgtgggctatgcatctttaccctttctcaaaaaaagagaaagaaaagactagctttgaggtggggagattctcaagtcactcatggaataaaagtattcatttttccaaaagtgagatctgtcacagcacaaggaggacactgacgacccctcgatttccattaggaatgtagaacactccctagccctctgatgccagcctgtgcaaaggtagtggtagcacacaccattaatcccagcactagggaggcagaggcaggcagatctctctaagctccaagacagccaggactacacagagaaaccctgtctttaaaaaaaaaaaaaaaggtctaaagactgggcatgtagctactataatccctcctgaggcaagaagatcaaaaattcaaggctggggcaggggctagatagatggctcagaagttaaaagcactgactgctcttccagaggtcctgagttcaattcccagcctccacatggagatttccaaccaactataataaggtctggtgccctcttctggcctgcagggacacatgcaggcagaacactatacataataaataagtaaatgaataaataaatcttttttaaaaattcaaggctggcctagcctacacaggaaagttgtatctcaaaagaaagggagatccagctagatagctcagtgagtaagggcgtttgccccagagcctgacaacctgggttcagctcccatggtagaacgagaaccgattcccaaaagttgccctctgagctctatatgtgcaccaaggtgacaagtacaggtatacaccacacacacacacacacacacactctctctctctctctctctctctctctctctctctctctctcacacacacacacacacatgttcactcacacacacaaacacacccaaagtgtttgtttgtttttttttaagatattaaaagaaaagaaagatcacttaagatggctaaaaacatggtcattctcagctgttttcaaggccagaatgggatgcataaatcaaatctcaaaacaaaaaacaaacaaaaggactagaaagatatctcagcagaagaaggcaccttgcatacaatcccagtgacttgaatttgatccctggagcccatggaaagatggaaagaaaaccagttgtgaatgagccatggcactcgtgtaccaacgctcacgtaggcatgatacacgatacacatgatacatgatacacatcatacacgataataagatgcctaagaacctctaaaaaatattcttgtatctgtaggtttctctttttctgagaagctttcaatttgaggcattggaatatattaaagaaatattctggtatcctagctcactccctttgccatgacaaataccatgacctgaaaacaaactaaggaaagaacaagtttattccagcttagtggttacaatctatcactgaagtaagtcagggcaagaaactcaaacaggtaagttcttaaagcagaaaggagccttagatgcatgctgaactgggcttgtctaccaagcagtgagcaacctaagttaactttaactggaaactgtacacaagctaagaaggggtctcagtccaggaattacccagctcaaattagcctgtaggcacgtctgtgagtggggttttttttcttcttcttcttttttttttcctcgattataaattggtatcagagggcccagctcattgtgggtggcactgttccctgtacaggtcctgggctgtataagaaagctagctaagtaatgagcttgtgagagtaagccaacagtcatcagtgttcttgcatggtttctgccattccaaattttcctgggcttttatatttagccaaggtccatggcaagatggtgacatctagtggtgaggcctttgaaaagggttcatatagatccgtgcacatctggctctcccagattcctggtgcacatgagtcacttcaataacctgatcctggcattctgtaggagttggttctctccttccaccatgagggttccagggtggaactcaggttgtcaggcttggcaataagtacctttaaccactgagccatctcactggctctcatgagtatgtcttaataattgatcataaaaagcccaatatcaggggctagagagatagactcagttgctaagaacacttgttcttgctgaggacctgggttcagttcccagcacccacatggtggttcatcactctagtaccctaactccagttccagggagtctgactccattcttttgacctctggggtcactagacacagatgtatgcatatataacatgcaggcaaaacattgctacacataaaaagaaacaaaataacttcataagcaaaatgtatcttaaaagcatctagttctagataattgtgggtttgtttatttgtttgttttaattcacttctgtgttttctttcagtgattccttatagatcagtgatcattccaattaaaaagctgagcaatgcgatcattacatcaaacccgtggatctgtgtttcaggagagctaggagacactggagtaatgcagattccaaaaaacctgcttgagatgacttttgaggtaggttagccaatacctttttaattctacagaagaaatctggttttgccttttcattttttccttggaacaaatgaaataaaggaacatgcagttatgtaggatcattttgttattgtagccttatacatgtctgaagcaacttacactagttagctttttatttttatttctagaccctatttttctacttgtagtaggctttaccaggtcttgttccttgattcccagcgcctaacacagaacatgacaaacagaaaatgttaagtaaaagctttccctaaagtggtttctcttcaggacgagagagctgatgtccatgcttatggcttttgaagtacaaagtgacatacatacattagtatgctttttgttttgttttttcttttctttttttggtttttttcaagacagggtttctctgtagctttggaggctgtcctggaacaagtcttgaactcacatagatccacctgcctctgcctcctgagttctggaattaaaggtgtgcgccaccaacacccagacattattttgttttttcaagatagagtttctctgtgtaacagccctgaatgtccaggaactcactctgtagaacagggtagccttgaactcggagatctgcctgcctctggctcccaggtactgggattaaatgtgtgtgccaccaccgagcagttcctataaatatgactttttatattgtcagttttggacaatataaaagatctgcctgcctctgcctcctgagtgctgggattaaaggtgtgcgccaccaacacccggcaggaatagtcattttcatttggaatcataatcccaagcccaacagtagtccatttggccttatgtatggggcagactcacatctatttgtatgtaaaagttaaaaaccaccaggtggtggtggcacatgcctttaatcccagcacttgggaggcaaaagcatgcagaatttctattaccattgctgtattttgtgcttgtccccaaaaggccagcaaggacattaataactacagttcattcgtaatgtcactttctacagttgtggtacctgctgttcattgtggtccaaaaacataaagtggaaaattccaaaagcaaaaattcatagaagctgagcatgatgtattcctataaccttggcacttgagaagcagagacagggtcagagaagttcaaggcatcatcagctccatagcaggtttgagatcagcctgggttgcatgagttcatgtctctaagagcaaaacaataaaaataagaagccaggcatggtggtacatgcctggattccggcactcgggatagaagcagaagaatgctgcaagttcaaagccttcctgggctgcctaatgaaactatctcaaaaacaaaacaaaaattaaaaattatgagtgtgcctggcggtggtggcacacgcctttaatcccagcactcaggaggcagaggcaggtggatctatgtgagttcaagaccagcctgatctacaagagctggtatttcaattgtacaacatggtaaattgcacaatgaaacctgtgctgtttctgtgtcagccatgaattctgtctttttctaacgtgtttgtgtgtgtgctaccctcccatttaggttatcagattgcagtggcttgtgtctatgtaacctttatttcacttattagtggccctacagcataagagtaatgtttcagagaaggatccaggccataaaacatggaacaactctggtatatgtagcaacatccccatgcgtataggaaagatacagtatttgtaggtttggtattgggaagtctcacacacctactgggagtcttagagtatatcacttgtaggtaagatgatttttacaaatagcttcttaaacttctctagtagatcagagccttgaacatgctagacaagcactctaccactgaactataccctagtcccttgttaaaaaatataaaaccctatcagttagtgatttttttttaaaaaattggctgtttgctctaagtcaatctaaataagatccttccccacttactgaaatcctttttacccttaagctgaggcataaatcattattagtgattctgtttctggattccccaaatagaaataaatgttacttctccagcactcctctaacacttgcttacatttctggtccagcacaccaagcactccgtcccatttggtagtcagtgtccatctcctgtctcgttgtatgaaggtccctgagcgcaaagactattaaatttatgccattaaacttagcacactgtgaagggtaggtctctgtgctaaatggagccaaagttgaaagggaatagaaaagaactgagtacagaataatttgtggtcctgtctctacagtgccagaacctgggaaagctcactacagttcagattggccacgataactccggactgttagctaaatggctagtggattgtgtcatggtcagaaatgaaatcacaggacatacatataggtgagtaaatggacttaggaggagcagaattctttatctcaaaactctttaggtaacaaaatgtttttaattttcctaaagccttccctctatctcccaaactagtttttgaggggatgtattattttgttctatttatagaacacaaaattggccaggtatgattgtctagaccttaagtcccagaattcaagagatagagacaggcatatctctgagtttgaggccaccctggtctataaagcagccaaggctacttagaatgatgatgatgatgatgatgatgatgatgatgatgatgatgatgatgatgatgatgataaatagttgctaacagttctttttaaacaaacagattggggctgacaagatggctcagcaataagagcacttatactctatccaagttcagatctcagcacccacctcaggtagcttacaactgcctgcaactccagccctaggatatccagtgcctttgctggcctctatgggtatcacatgcatctgcacatgtgtgtacacaagcacacacaaatgcatacatacacagacatgaataagaaaaaaatatttaatctttggtaaaacagattgtggaagctagagaaatagcttggtggttaagagggcttgatgctttcagttcccagcacctacatggcagatcacagtcgtctgtagctccaattccagagatccagtactcactctggcctctgcaggcacaggcatacacatggcacacagacatacatacagacacacactcatagatataaaataataaaatcttaatttagtgtgtctgtattctctctctctgtgtagcactggtgtagacaacctatcttggaattcacagagctctgcttcccaagtgctagatttaaaggcatatattaccacacctagctgttctctactgttctatgtttttgaaatttctcatggtgaaacgaacacttctcagatattagcatcatggactttacctacaacgccattttaaaatctttaattaaaactctaggaagccaagcgtgatgtcactcaggtctataatcccagtactccagaaactgaagcagaagattgcctggagttagagaccagcctgatagccttcgaataataaattctaggatagccttagcagcagagtgagaacccatctcaaaatgaaaacaagacaaaatcctagttttaaaaatgtagattcatgggatctctggagaccagagtaagttcacaacaacaacaaaagtagattcaaaagattttaaatcaaaagaatttttttttttcctgccctgtcagattcccatgtgggcggtggctggggaaaggcatcgatgatggaagcctggaaagaattcttattggagaattgatgacatcagcttcagatgaagacctgggaaagcagtgtcggactccaccacagcagaaatctcccacgacaaccaggagactaagtatcacgtcactaacaggaaagacctccagtgagttgttttctagtgtaccgcctcgggtattgcaggcttctgtggcccatttcccagaaagcagttgtgttaatgaattatggtgaggagatttacaaagatggactggggaatgactcagaagatacagtgcgctcttccctcgcataaggctcggagttacattcccagcaccctccagccgggttccaagcattcaaatagatgagcctgtgggggtaattctcattcaaactgccactgtgatttcaggtcccatgcgggcagcctaccaagccacctagaaagaggcgcagatgaccagtgctcacagggggaatggagcgaggagggtgaccagtcaggaagggaagaaaagaaagcctgacttctggccagcgcaccgcgtggcatctagctagcttcttcccttaaaccacaacagcagaatttcacgtaggtcactgagagcctcgatgccttagcaaatacctgcaagattcttggctgggaacctctgagcaatgatgaagggaaccttcctcacttcattccccacatcgggagagtgttgcactttgtgatgggaaccccgccacgtgattgcatcgactatcttgttctgttttctcagtgaggagcgtttgttggtttgggtttgttttgttttgttcttgttctgttgtggtttggttttttgtttgtttgtttgttttttaagatttatttatttattacgtataaattgttctgcctgcatgtatccctgcgctccagatcacattacggatggttgtgagccaccatgtggttgctgggaattgaacacaggacctctggaagatcagccagtgctcttaacctctgagccatctctccagcccttggttttgtttttcaactattttcagttgagaaaagccagaggaaattaaacatgtggcttgtgttgtggttcgaaggtagtgtggctgagatttgagtctcgggtctcttgggttcttcagacttggccattttatccagtagcaaactggaaaagcgagcttgctcaaatgaagtttttcctgcagggacttaacagtcgaataccccatagtatttttgttcatttatttcttacaagaatgtagacgctattaattaattattttgcagaacccaatgctggacagatccaggaaggaattggagaagctgtgaacaatattgtaaagcactttcacaaacctgagaaggaggtattatggggcaggaaagctgtgtgtatagtggggcttttttttaatttatttattttgagacagggtttctctgtgtagcgctgtcctggaacttgctctatagaccagctggcctcaaaatccacctgcctctgcctcatgggattaaagtcatgcaccatccccacctggctaccctcagctcttgtttctctagtatggttgttatttgggggtgctggggggttactttatttcatttgtataagtgttttgcttgcatgtatgtctgtgtaccacatgtgtgcctggtgcctgcaaagctagaagctagcattggttcccctggaactgtagttaaggatggttgtgagccacagtgtgggtgctgggaactgaacccaggtcctttgaaagaacagccagtgctctttgtcactgagccatctctacagcccctctagtgttggttggttttgcttttgtttttgttttgtttaagcgtagaagcagcagaattcccttgttactgtgttaacattatggtttacagagaggaagccttacagtgctgctgtgcggagaaaatggcctggttgctgcactggaacaggttttccatcacgggttcaaatctgcccgcatctttcacaagaatgtcttcatctgggacttcgtaggtaaattaagtagatgtatgttactataaagacactgaagtgtttctttaaaaaccctgcaagctggggctggagagatggctcagaggttaaaagcactgactgctctttcagaggtcctaagttcaattcccagcaaccacatggtggctcacaacaatctgtaatgagatctggtgccctcttctcccctgcagggatacatgcagacaggtcactatataaaataaataagtatataagtaaatttaaaagaataaagtaaaactcaccaggcgttggtggtgcaggcctttaatcccagcactcgggagacagaggcagacggatctctgtgagtttttaggccagcctggtctctagggcgagtgccaggataggctccaaagctacatagagaaaccctgtctcaaaaaactaaataaataactaaataaaactcaaaaagccaattttttttttatttattaattcaagttagggaacaagcttgtttcacatgtaagtcccttctccgtcccctcaccccctttctttattctgtatatctttcttattccatggctggctgtgtgacagagtttctggctcctggtgtcatcctctccttctccttttcttgctcctccctcctcttctctccagggagcctagatttctcctcttatctattctctctgcccagcagccctgcctagctactggccattcatctctttattagaccaatcaggtgctttaggcaggcaaggtatcttcattccaccctctcttaaaaagccaaaattttaaatgaatagaaattagtaatacactagtatgtttgggggctaatgagggttcaacaagtagaggccctgagtttgatcccaggcacctaccaggtggaaagagagaactgactcccacaagttgcccccacacatacacacacagtgttcactaaaataaaagagggggctggagagataactcagcagttaggagcgtttgctgttcttccagaggcctgggaactcaaccacatggtggctcacagctctccttacctataattccaggggatctgatgccctttgctggcttctgaaggtactgtactcccatagtacacacaggcatacaggcaggcagaactcccatacatgtaaaataaggataaacaagtcttttaaaaagtgtcctaagtcttttttgttttgtttttcgagacagggtttctctatgtagctttggagcctatcctggcactcactctggagaccaggctggcctcgaactcacagagatccgcctgcctctgcctcccgagtgctgggattaaaggtgtgtgccaccaacgcccggccttcttttttttttttttttttttttttggtgtgtgtgtgtgtgtgtgtcctgagtcttgtgattttctttcccctttaggtatataggattctaaacctcctagtttctttaaagggtcagtgagccatttttgtgtttgtgacgttggcctacatgaactttcgggcaaagaaagggaaattggccatgcacctaagagtgattttgttccccctcctttctagaaagcttagaattttactgctcctggctctaatgtctgcagctctctcagattaagtcagtactccacaaggcccatttaggtccatttaataatcttactgatggtagccattctagaagagggcaccacaccatcttaatggtcaaatggtcactgtgttgattcatggaagggttcactcttaggagataattcctttcatttcgtggttccttctctctctcctctctctctctctctctctctctctctctctctttaatgcttttgtttttttaatgccattttctgtttcatgaagacattttaaaagaataaactttccagccctctggaatgtggtcttgaaaataaattactagacaggtggggggggggggggctcgcctttaatcccagcaccaggaatcatactgctttggcatgaacttcttaagctctctgtgattcattctgaaatcagtgataaactaatgatttggagtaggggactgtgaagccaagccccagtagagtttccagaataaattagatggcatttctgcatacaactgttgtagtgtgttgtgattctgcttgtcttcctcagagaaagcagtggcttattttgaaaccactgaccagattttagacaatgaagatgatgtactcattcagaaatcatcttgcaagaccttctgccactatgtgaatgctattaatactgcacccaggagcattgggaaggatggcaaattccagattctagtttgccttggaacaaggtacagagtcaaagttacgctttccttatttttgttacgtgggtaagaaaagttatatgccaggttatggctatttctcttgtgtttcttctttccaacttttattatgagactactgtctcccgggcacctttctgttacagtagaaactgatttacccatttcttaagaaggtttctgtgttttattttgtatatgaatggtggtttgcctcgcttggtgtggtggctcacactattaatcctagcactcaggaaacagacttgaagatctttgagctcaaggccagcctggtttacaaatcaagttccagtactacagagagaaatcctgttactaaaagccaaaaataaatagataaatgtatgttcttttgcctgcatgtgtgtatgcgctaattatctggtgcctgcagcaaccagaagagggtgctggagttaaagacagttgtgagcaatgtttgggccctggaaattggacctagatcctctgcaaaagcagaaaatgctatttaacactgagccatctctccagcccccatatacctattttataagtcagaaaataggaattagataggcccaaatacattagcaaactatcccaaaatcgcatagtaagaaaatagccattccttatggcactggtctgtaataccagcccttcaggaagcaaaggcagacaaatcacaaggttaggcattgccttggccacagagcaagttcaggacctgactaggaagttagttagtgagacactgtctcaaaatatgaaaagagggcgggggtggggcttagaggtagaggccttaaccagtatgcacaaggacctaggttaaatctacaccactgagcaggggagggagtgataaataaatgtttagtgaaaatcgagataattttattgtttttgtttgttggttttgctttttgttttttgagacagggtttctctgtggaacttcctttgtagaccaggctgaccttgaactcaaagaaatatgtctgtctctgcctgccaagtgcctagccagcccttacccaggaggagtttcgagagggacactgagatggattaccggggaatactgggttaattagcaaagttgttaactgaacaaagaaatgaaataaaaggatgttgacattactactcctaaagtatggagaacatttttactgtagatacaaggagaaagcaggcagagagaagaatgcaggctgatcatggccagaaaattaaactggaccatgagagaagagaaggggagagagagcaagagaggagccactaaccaagagaggtggcttggaccaagacccaaaatggctgagttatgagggatcaggctaggggaagagaagccaagcccctgaggtggagtagtttagggtaagggtgccgggtgagaagtgcaagagggcccatgggtgtgctgagagagatttatcctgggtttgcaaccaacatctacatagtggacagacaaaggggccactaggagagtggtctgcaacctaacatctacatagtggacagacagaaggggccactaggagagaggcctacgcagacagcatggtaggggctctgaagaggggagccacagcccacacaatggaaataatattctattcttacttctttctgagaatgggaaagtttttacattacaagcctgtagctaggctctcgattcccagagaggcaggaggggggggaacaggatgtgtggccaatacttcctttgatgtaaacttacttccaaagtgtgctaccattaacatagaatttggctgggttgggcaccatccaactcctactctccctagtgtgtgtacattgtgtattgttcatgcctgacctgtgggtcacagcttgtgccacaagccaggctcagctacctgtcctggttaagcaaagtaaaattgccaaattaatagtgaaagcaggggctagagagatggctcagcagttaagagcactccctgctattccagaggaccctggttcagttcccagcacccacatcaagcagcaaataaccacctttaactctgactccagggggtgtggtcaccacttctgacctccataggcattgtacacacatggcacaaacatatatatatattttcctagtccaacatagggctgggacttgaggaaaaggattgtgaaaagtttctataccctgataagcaagcctctctgccgatgtagcagtctgtaagacccccggaggctcaggcccccaggatcttggccagaaccgaggccaccccaatcaccaggtgaaggcaaaaacctgatgcaaacagcacgaggctttattgcagttgtttaacgagctaaccccatgttaacttgggcctttcatccatccaccatggcagatggctaggaaagatgctgagaagccacgccatagagatcttaaaggggagtgtctaggggtatgcacaggctcaggattggtgtgcctccaggcttggaggacttgccctgtgttgattggtcaagtggtttttatgtcccataggccctcccagggtgattgctatgctctgtgcatcattgctgtgcacttgtctgtaaagcatagcatcaccagctaacttctgagccaggcatctgacctcatagtgaccaaggtcaggcaagcacgtattagactgttatggctgctgaaatggggggagctggtcccttcagtccaaatcagaccaaatcaaatcaaattagaaaaagcccatgtttaatggatacatcgctcaaagctcctgtatggcctcccagccccctagagaggagacaggaaagacagccccggaaaaccacaggtctattttctgggggatggtttaaataccctgtgggagtggtcttgagcatctcaggggggctttctgagatgcaacagggtttggagggagatagtggaatggggcttgggtggagcttctgtcccaccaaagtaaatccacccattattttctaagctccatatctctcctacaaggtcacctgacaagttcttcctcagtctgcaccaaagacttaagccttctcccaggagacgattccttgggggaacttttattttactttgagacagggtttcactatgtagctctgactagcctagaactcgttatatagacaaagctgacctcaaacttaagagatctgccggcatctgctttccaagtgcttggacgaaacaggtgtgtgccaccacagatgctcctaggagaaccccttttttttttggggggggggttccaggcagtgtttctctgtggctttggaagctgtcctggaactagctcttgtagaccaggctggtctcgatagtgctgggattaaaggagttggccaccccataccccattcccactcccacccccatccccagcttaatgtattgtagtattattgtttcaataggctgataattaaggggaaagacacaagggaggtccctttacaatgtaccccttagagctcagacactgtttctgtttgggtctgtagggatcacctgctcccacagtggattccattgctagcagaatgtcctgccatcacccgaatgtatgaagagagcgcactcctccgagaccacatgactgtcaactcccttatccgaattctgcagaccatttaggatttcaccatagtcttggaagggtctctcatcaaaggagtagatgtgtaaaccagctgacagaaactcttcatcctggccctggctcccgaacctcccccaactgtgggacctcatttgcactggtctgacaatagtgagcactgcctgggcagtgcacccatgggaagcccagtatgaacagtcgccactctgcacacaaggcaaagtgctgtattgtagttcatttgaacctgaaatttagtataaaacagagtattttcatgtgttagatgtgtgtaaatatgctatctttaagaaattatattactctaataagatacttttcttagattgaatattcctgtgacttaaaattagtagcctaaaaaaaaaagttgggggtggggagagtggtgctagtcaggaagaagccagtcaatgtgtaaattgcgcgcccagtagggcttctttttccctcctggtatcttgaaggaacccagaatgcattgttctgaagcagccatccttcctggagttccatcctgtgtgtggtgaatgtacacagctttacatactgtacagcagtatgtacctttaagttataaaccatttaatacgtttgaattatgagtcacttctccagtttggtggaaattttttcaattggtacaagtaaaagatataattaaagtattttaaaattttaaataccaggnnnnnnnnnnnnnnnnnnnnnnnnnnnnnnnnnnnnnnnnnnnnnnnnnnnnnnnnnnnnnnnnnnnnntttgaaaaaaaaacacaagaagccctgagaagtgtgttcaagtgtgggattacagcttctttaatttggaaagattagcctgaagtagcttcattcttggaatttttgtgactgttgtttgagaataccttggagataatgaatttcagcattaatcgtatagtcataataactgcaaaagaaaaccagtgtgactctgtgcttttcacttggccacctaaactctaaccagagttagactaccaaccctgcctttgttaggttccagccaccccctctgccagggccccatcccccctcaggaaatggaaggaatgtgggagaaggaggaggtctctgtgtgattggaatgcttttgtgaaagtatttgttgaccatgataatgcaaataacaggggcagagagaaagaatgaagcctttctgggtgtttcagggcaatgtgaggcaattggcatgaagaagttaagagccactggggcagactgagaagtgaaattgagacaacaatttagaaagacctgaagttagaactttctagtttgatagtctattttttaagctaaataaatatgttagcagttgcataggtctttatcttctggtgagtaaattcgtagaactctaattaggcactgataccctgttagcagaaaaattgtctcctcaaagctccaggtttattccccattgcagctgaaaaacagagctatgggctccgaggagccttgcgcaatataagggtcctgggctcttgccaacagtgttgttttcctcatttactataggaagaaactgatagaccaggggcctcactccctgaatcagagactgactgttcagccaaggaacagctcctgggaatgtgaatagaaaggggctccagatgacctgggtaaaccagacatttgtttacctaaaataaaagtgtgtctaaagtattcgactattgtagagacacaaacctgctatgggaaacatccataagctatcaatggtccattccaggatgttactgttctcttttcccatagggccatcatcctgacactgagcactggatagattttaagtaagtatgccacaattgagtcaactagtgcagcttcttcattttatacatggaacagagtcaaggaggtaattaatagtcttgcccccccccaccttgacaacacaggatttggagtttatgctttttaccacaccagatgcatgaaaccaaccttcaaggcattcttacttaatagtatttcttctgttgagtcttcattcacctgtagagatgtgaagcaatattcctgtaatacttagtaaggactgatacttaagttaaattgttttgctgtgttgttgcgtgtaaaacaagatctctctgtgtatggctctgaccagccttggaactccatttgtagacatgctggcctgaaactcacagagatttacctgcctctgcctcctgaatgaggggaatattcaagtgagtgccctgcccaacaaactgttcttaactctttgttgttgttttgttttgttttttccagacacagtttctctgtacagctttggggcctgtcctggcacttactctgtagaccaggatggtatcgaactcatggagatcctcctgtctctgcctcccgagtgctgggactaaagttgtgtgccaccactgcccagcttgttcttaccttcttagacattacatctgttgtaaaaactgcattacagcttgtgtttaaaactgttacttaaaacgtaataccaaaaaaaaaaaaattacctataaaagttgccatgtggtatcatttggatgaactagtgaaatggctgattaaaactatcatacatcctctcaaagactggccttaccccttggtggtaatctttgccatatggaatagatgtaatatgtagaaatactataaagaccttaggagaatgctcccactgagtttggggttaccaattacaaatgataaagaagtaagacttaccatgtggcttataacaacctgaatcagtatgagacatatttacattaccacaaaagcagattcctcagaactaatgcacataaccataaggattcaggcattattctggcctgcccctgtcacctggcaggatgcactcaggcagtgccctggtcagcccagggtcccatgattgcatggatgcctgtgcagaggacccccgcccacttatgctcctttcccgctgttccctgggggcagaaaggactcttcctgtcttcctcttctcttgtgtcctctctgtgtgtctctgtgctccttcacctctgttctcttcccttccccttcctccccttccctcccctctctaatacaacttcacacataagctctgcctgccaggcatgtttgtcccccacctgggtcaccctcgcctgccttggaatccgccaaggtcccccaaacgctttatcataataaccatccaaggaccatacgacaggcacctttcttgctgtgcatttttgtttaaactagtatcatgctttggaatcacctcaaagtaaatgaaaatcaaaactgcttcttttgtgtatatgattgtccaaatcactttaaagcaaatatctgggaccataattaatattccacatagtaacttggaagtactttttttgggggggaagggtttgagacagggtttttctgtggctttggaggctgtcctggaactagcttttgaggacaggctggccttgaactcacagagatccatctgcctctgcctcccgagtgctgggattaaaggcatgtgccaccaccaccccgctagaggtaacttgttttaaagttaaatctgcaaggctgaagtgatgcctaagcagttaaaagcactgcctactcttgcagaggacccaggttcagttcccagcacctacatggtaacttacaaccacttgttactatagttgcaggagatccatgccttcttctgatctctttaggcacccagtatggtgagcatatatacatagaagcaaaacactcataaaataaaaaacattcataaaataaaaaattattaaatttgccatgtctggggatgtagttcagtggtggagtatttatgtactatgtacaaaacctggggttctgtcctcaacagtcaaaaataaaattgccaaaatctcaactccttcaaaagcttatttgccaagtatttttcttgagtactaaaatctctaaccacaaccttcatgtcacctttatggtagctttataatagtttccatgttatgtgtgaaaagttttctatgctacgggaagcagggtgtcctcagcgccttagcatggctgagactgtccctgtgagcgggaaaagcagggttaccaagaacaagcggagctgcccaacctgaccttgtttcccactgggaaacctaaaatttgcaaaggtggaatttcatctaaaattcattttaaatgtttgtacttactgtaccttttctagctctgtggggtttattttaacatgactttttaagaaattattttaatgaacttctataacactatgagttagttacactacaccaagtcgcttctacttttcggacagtgagttcacatatatgtaaatgtagtgaaaaatacattaagactatgcatagtacctcatgtgtagcaggtgttaatatctctaaaatattttaaaagatgaggcagtacacaaggagggtccccaggaaaatatttgacagcattgggaatagagctcttcattcataatgtgaaatatgttctaagaatagtggctttccaagagatttttttgttgttgtttaggaaattgtattttctctgaggtctacagaggctagtctactcttttcatggtgttgaaagggcactctgaactctacttacatatgtcagcattaacacacttttattgattgacatcagaactctcttcctttctgataagagtaaatactacttccaggcctctctttcttgtctggttagttggtttgttttggttttgatttttgttggttttggttttggttttagttttggttttcgagacagggtttctctgtgtaacagccttggccatcctgcaactcactccatagaccaggttggtctctgaactcacaaagatccgcctgcctctgcctcctaagtgctgggatcaaaaatgtgcgccagcacacctggcaagcatctatgtttttagaaatatttgtttcctatataactatttattgcattatcatttagcataacaaagagaaagatgtcctttttttccattaaaatacatatgcaaatcttctagatcaaaccgaattttgagattcttgaagagatttgcttttacagtatgatgaaaggaagccaaggaggggctggactggagctcagtcaacttgtgtgcttagcatacacaaggccctgggcgctcagcaccccaacaaaagagaacaataaatccaaggatgatcataccttcccaaatgggatgcctcttttaaggataaggtcaaaattcagaaagacacactgaggtatttatatttatatcagactgaaaaataaattacccaattcctgcttttagaaagggttctgctatatccttagttatttaggaaggagccagcttgatccagttacttgtggattggatccaatgtgtattttaaacaaattttgatgtagaagggaatagtaaggtcaaatgatgatgtaaaacagaaaaaaaaatctgctgcacttgaaccacatgtaaaggtatcttgtgtttgtttgtttgcttttaattaatatttctccatttaaattattgtttccctttgtattattaacaatgtgtgtctgaactggaattttctcccccttcccaatctgaacataatatgaaatctgaagagtattgtgatattaagcactttaacatatcgaacaaactgacttggatttttcaggttttggagtacatttaaatatgacttttcatgctttgttctttacaaataaaactggggttgatactttgttttgtttcattattgggtcttactaaaagtttcacaagataagatacttaaaaagcagagataaaactaaaatcattatacagcactcaggaggcagaggcaggtgaatctctgtgagttcgagttcagcctggtctacagaatgagttccaggacagcctccaaagccacagagaaaccctgtctcaaaaaaacaaaacaaaaacaaacaaaaaactaaaatcattatatagaaaagtaagtaaaaacctgctgaacatgggattattcagtgtggtagtttgaatggatgtggccccatagacccatgtgtttaaatgcttggcttataggaagtggcactattaggaggtgtagtcttgttggaggaagtatgtcactattagggcaggctttgaggtctcatatgctcaagctgcacccagcatgggacacagttcacttcccattgccttcagatcaagatgtagaactctcagctaccatgtctgccagcacaccgccataatgctaatggactaaacctctgttattgtaaaccaacctcaaatgttttcatttacaaaagtcatggttgctgggtggtggtaagcacatgcctttaatcccagcacttgggaggcagacaggtggatctctatgaattcaaggccagcctggtctacagagctagttccaggacagctgaactttgccaagacagtcctttttgaaggacagtccttcaaaaattcctgcttcacagaaaagtctgtcagatcttttaggtccatagactgaagatggatgccccaatgttgcggaagaattttgggtgactgtccaggaatccagatgtctctgttgtctctatatttttggaagttgtttgcaatgcactttgtttgtacaggtaatattatatccttctgaggtctttcatggaattgaagactagatagttatatttttccttagtcatgatagaaggtaaattaggtacaaaacattggattcaccaacagagaataaataatggactattttctttaaaattgccaaatataagtgcactggacattttaactgtaattcttacctgataattgttcttattgtatacagtttttatttagaagaaagggaaatattacaagatatttgattacactgagtaaaaatatatcactgtgactgggtggtggtggcatacacctttaatcccagcacttgggaggcagaggcaggcggatctctgtgagtttgaggccagcctggtcttcaaagagagttccaggacagtctccaaaacatacagagaaaccctgtcttgaaaaaccaaacacattttcagggcagagaggatactgagaagaaaaagggtgaagtcacagggagccaccaggagaaacaaagggagcaagacatgctggaggacaggtaaagtcatgagccatgtggcaatacacagattaatagaaatgggttaacttaaagtgtaagagctaattagtaatcccagcactcgagaggcagaggcaggcggatctctgtgagttcgaggccaggtctccagagcgagtgccaggataggctccaaagctacacagagaaaccctgtctggaaaaaaaaaaaaaaaaaagctaattagtaataagcctaagttatggccaagcttttattattaatcaccagtctccatgtcattaatggggagccagcaatcctgaggaaaaggtccaactatagagcagagctcttccgtggccactgcatcagctcctgcctccaagttcttgctctgtttgagttcttgtcctgacttccttcaaggatgaagagtgacgtggaatggtaagataaataaacccattcctcctcaagttgcttttggtcatggtgttttatcacagcaatagtaaccctaactaaaacagggattggggaggggtttccctttggacctgaaagtccacaagcatacatgtgggcaaaacagtcataacataaaaattttttaaaaagaatgtaagctcatacagccattatggaaataagtaaagctgaaaatttataggggttggcaagattgtttagcaaaggtacttgctgccaagcttgacaatctgggttcgggccccaggatccacatggtggaagtacagaattaacttctgcaatttgtcctctgacctctacagacacatcttgatatgcccctaccatgtagcagtgtcttgcctgtgaacctgtaacggtggccacacccctttgggtgtggcttcaggcagacagaagcagaaagagggaagtggaagtatgaggcatggcttctcttgtgtgcagtctttcttttgagtcagccgatccaataggaagggcagagaaacactcccgaggttctttattatcatctgtgtaagtgttccccaataaacacccattatcatttatcttgggtctagtgaaatctttgtatccttgttttcaccaccatacacataaacaatttgagaaaatttgttttctcaaataaaatttgagaaaaaattttaagctgaaaataaaactactatgtgacccaactctcctaatcctggatgtgtacctaaaagattctaagagatacctacacccccatgttttcactgctatatattcacagtagccagaaaacaaagccagcctagctgttcattaacaaatgagtatataaagaaactgtggtacagacacaatggaatttttaacgatttatttatttttattatgtatgtgttacatatatgtgtgtgagcatgagtgtgccatggcatacctgtgggagtaagagggtaactcgggagttaagttctccttctctcatgtagggttcagagatcaaacacaaataagtcatcagggctggtgacaagtgcctttacctgttaagcaaatatatgtaaagtaaaatagaaaaactttcttaattgggtgtggtgtgtgtgatgaaactagaaacgggatcatgagtgaaaaggaagaaatgttacgtgaggaaaagataaggtaatagggtatacctgataagaggatagtaaggtaggttatctgggggcaagaaatgagacaagcttgatcagggccttggtccaggggtaagatgacatcataaaacccatcattttgtaagctaatctaaatttttaattgaaaaaaatccataaacccaaatgtggcatcgaaactgcctttcctagaagataagcccaaatatgtgagggggtactgtgaggatagagtaggtaaagttacagacagcaagttgaaccataggttaaaagggtaatgaaggtgtacacaaatacacctgaaatgttagcataagaaccaccacaaagaatgaaaacaggctctcgggcccatgctttgtctagaagcctctttttcataacagccttttttttttctttgaagaatacttatttttgcccagcttttatctgtttgaaaatgtttatgaccatggaagaataaacaacttcctcagctccgtaaactcttccaaacttgtaggacagcaaaaatactagatggtgctggctgtactttgaaaaagaatagttgatctaggctgtggaaagggattaaagagaccagggcaggaatgtggttgaacagaactgatgatacatgcagtgtaaagacctttcttacctgtggaaccattttagacgctgtttctccaatagtaactttataacaacaaaaagcctgtgtgtgtgtgtgtgtgtgtgtgtgtgtgtgtgtgtgtgtggagagagagggaaagagatagagagagagagcgaggggggggatatgagctgggctcattgcttttcctcaaacaatcctgtatattaaacatcatgggctgcaaaagtagctctgttggtagagtgcttgcctaacaagctggaagcctgactggtttagtcgtcaaccctgcatatactgggtgtggtgtcaaatgcctataattccaacactaaagacggggaggcaggaggatcaggagttcaagatcagccttgggcatatattaaataagaagctaccttgtgccaggcagcggtggcacacacctttaatcccagcactcacaaggcagagaaaagtggatctctgtgagtttgagactagcctggtctacagagcaagttccaggacagactccaaagccgcagagaaactctgcctcgaaacgaacccccctcccaaaaaaaaaaagaaagaaagaaaagagaaaaaaagaagctaacttgcagtatatgaggccctatctcaaaaataactaccagcagtggtggcgcacgcctttaatcccagcactcgggaggcagaggcaggcagatctaacaccatagcccatagcccttgttattggctaagtgaaaaagaaaaaaaaaaaaaataggaaactgaagttgatgttgctggcctcagcaagcaaaatccctgaccttctgctctcctttcacctgtttctttccccccaaccccaaggcaggtcttagaaatggttatctcctccgttggccctttgaccggtagggactaagacctgcctcacagagggcccagccccagacatagaggagaaatgctgaagaatcccgacagacaggccttgctgggtttcctacctgacagctgtccgtcagtgcttgactaagatgatcttttggtccagtcccattgcagcatcgctgtgcattatttggtcacgcctacccagtgaagtttccatagagaccactggacatggttcagggagcttgttttggccgagcacatgacagttgagactggggcttgtctggcaaggccagggatgctctgaatgttgccacacaccatgcccagtgcatctcatcctctgtatccttcacaatcttgcatgacgaaaatgtttctctgaagtctgagagccattcaagcaaatgtgttgaaactgagacattctgaaaatactgactggtggaataattgttaaaacaatctagggcaggtggttatctccatacgatacaaggtgggacagtggcagatctcactgggaaagataaacttgccatcaggcagaacttaatgggaaggaagttttattgggaggggagatagagaaagggggacagggggagacagaacagacagggatcttctgtctgcctcctcagagagatggtgggggcagattgcctcttaaagggccagagtaagtacacctgccatgtatagagggctgaaaggcggggccaggtttgcctagattacaacaacagtgatgaacatccaccattgggatctgacatgatctccaacagacagttgcagcccttggtaaattaagggaaaggaactgggcatgatggttaatgtctgtattcccagcactcagttggctgacactggaggactttcacaagttccaggccagcatatggatagatagatagatagatagatagatagatagatagatagatagatagatagatagattttaatgcgattaaagatctgtctcagtggttaaaagtacttcttcttacagaggaccagtgttcagttcccagcatttacaaagtgactcacaaccatctgtaactctattcctagggtcccaacaccttcttctgacccccacagacaccaggcacacacatgctacatatatatacatgcaggaaaaacaaccacacagataaaataaataagtataaaaaaccatttttttaaagacaacaaaacccctaaagaaatgatagaatttattgactgtccagaaacagggaaaaacaagaaaagaaggttcaaggttttgaggcttagaagcagtggtttccagctattcattttcattgttgctcagtcttggccttgaagactgtgtgtatgtctaatatctggctggttacagatgcagtggttggccgagtggcaaaattccacatgtcgatggtcgatgagcagtgaaccccagctgcctgggtgccatgcttggggtacagtccatccccatggacataagctcctggctgctataggaagagccctatgttacctaacaatgaataagcacacaggaggagatgagtagggaatgagagaggacattttcagaactgtgagacccgccagctttctctgggcagtggcaggctggccagagaatgcagttgctttaatcagtaggaatttaagtaattagtataatgctgagcacaggtttacaagatttctcctttggacatgaaatttatttatctgggctgctgttttcctcagtttcattcctacttttaggcttgaggtttttgttttttggttttttgggtttttttgttttgttttgttttttctaaatggcatgtgggtatggcttgtaaatgataagcttggcacgttagcagctaaagcctgaagcagggagatgaaaccactgcatgaccgcctgtgctgtaaattgagtctggatatacttcacttactcaggaagctggtaacttgttgccaacagaaacctaaagaaacactttctgcaattaatatgttaactatcattaatggctttgttttctgcagaccagccaacagcttcttggtcttgataaacaggttctgaacatatgagctcagggagaacaggaccagcaaggatcccgctgtgaaatgctacccgcttcccaggatgaatcaaaacctggaacttaaggacttcatctcatgtgtcaggaatggttggtgacatatgttttacagctgccagtcccaggctttactaaacatacacatcttttcctacaacctggagggcagtgtgcctctctaacatactcccagctccccagttctcaaacctcacttcttacactccttgttattcttttgtttaaaagaagaaaagagaaatattgagatggacatattgactataagtttattataaggcagaatgggtagactaagaagaggaacagggcaatggctgaccgccatggccggtcgccatagagagacagagcggggaaacagagaggggacagagagcaggaacggggagagagagagagagagcgcgagcgtaaaggggcagagagagagcggggaggggcaggggaacccagtgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccttagaacctggagacaggagctcaaggccaggcttggctgcatgaaatcctgtctccaaaaacacaaagaaggaaagaaggcagggagtgggaaaacaaaacaaaacaaacaaacaaacaaacaaacaaaaacccttctggattcctcgagctttcttggaggtatctcagacccacagctgaggcagacccaggaaacaggaattgatgctgacttggggccctgataaacaaaacacagggccagttagcaacttgatctctttagggcacaccttccctgggtgctaagcatctgatctttatgcgtggttcattttatcccttcacagaaggcactgttctcatggctaatgagcatagaatcagtcttgtcactggtctttttaattttttacgtgtgtaaatgtgtgtgtgtacatacacaaacagagatcacaggacaagttgcaggagttggctctcttcttccactacgtgggccccagtaatggaatgcctattaacagacttgacagcaagtgcctttacctactgagcaatctcacctacccagtgctagtaatttttgattttttaaaacatcctaggcttaattcagctgctttcatgccaacattttgcctgcagcttattacgaagttcactgagagacagtataacgtcactgtggtggacacctcgaggcccaaacatggttcccttggtacagacagaatcaccttggacttctgaactgctctaatggcatccaaaggacacaaaggagatttctttctttctttctttctttctttctttctttcttcctttcttccttctttctgggggagtggaatggaggatggtggtgagacagtctcactcagtctgacctatgatcccctacacaggccaggctggctttgcattcacagaaatcctcctacctctgtgaccaagtactagaattacagctgtgcaccacccaccacagagctccaccgcacctccactttcagtctgtggtgagaaagacggggtcacactgctctcttacatccatgatgtcacccaaacttcagacacacttctctgaacacaaaggtaggaaaagctccattgtgtggtgagaaaggagaccaaagctaaatgctgctagtaaacacaagaatgcagagtaactgaggagggaaccagaatgccttcctgttactgggacttctaagacagaggttgaagtacaagaagcaaggttgacctggtgattttacaacactcacacacaatcacctttccatgctgaacaggactataatgtaatcccagcactcagcaagcagattcagggttgtcacaaatttgaggctagcctgatataatactcaggtgggttctgggtcaacaagggcaacttagtgagaccccatctcaaataagcatccctttctttcttttcttcgttccttcttcccttcccagtcctcatttgacttttattttgacacatagtgaagtcatctaggctggttttgaactttctcttctgactcaacctctgaagtagctgggactacaaacctgctccacagagcccagcaaatttttacatttcttttcccagcttcactttttagagactcctggctgatgggtgcagaaagtctctgtgattacctctgaatgaccgcttcaagtgccatgactccgtgtggaaggatccacctggagcctttcctgacatttgggtttctgttacccagaatctgccattgcactgacatgtgacctcacaaaccctggacattttccagctcagctttatttctataaagagacaacaagtattgtataaaaggagaatctattttcaataaaaaagatttatttatatatgtatattatgtatacacacatatttaaataaagagataatgaaacatacttcacaggattaccgtgaagattaaatgaagtaatatctgtggcattaagatgcttattaaatgtaactcctatacttaaagttaattattattagctcttattaaatgacacttgagggaagataaattttactaggttattggagtcacacatgagcaattgtttacagagtacagttgttctgttgaggcaagagacttctcaccagtatagtataactaaaataatcagaaatgatccttaaggaactaaactatagctggttatggcagtgcatgccgggagtctccatacccaggaggctttggcaggagtattgacggaagtttgaggtcaacctgggctacatagcaagactcaaaaataaaaataaaagaaaatagacctcgcctatgttttcccattactttccttcagaatatttactacaaatttataacattaatattatttaatttgtatatacatttacttaaaatatttctcccaaaccaggtatggtggcccatacctttaataccagcactcaggaggcagaggcaggaggatctctgtgagtttgaagccagccttgtctacagtgagttccaggacaaccagggctgttacacagagaaacaaatgtcttgaaaaaccaaatataggactggagagatggctcagagtttaagagcactggctgctcttccagaggtcctgagttcaattcccagcaaccacatggtggctcataaccaccaataatgagactctgagggctgtgctctcctggtagagctgagtcttgaggtagattgattcccagttttctgaggaacggccatattgatttccatagtggctgtacaagtttgcactccaacttgctgtcagacctttctgtcaggactgctggctcccaaataatgacactgagattattttattaattataaaagaccagcctatagcttagcttaggcttgttactagccagctcttacagattaaattaaccctgtttttaatcaatctacttttcatcttgtggctttattacctttactctgtactgcccacgctgcttcctctacatctagctggagaatctccccttctccttccctgtgtgcctgaagatcctagccactggacatttagtttttcattaagcaaatcagaacaacacatcttcacagtgtactaaaagtttattccacagcacccaccagcaacggaggtgtgtctcccttgcttcacatcctttgcctgtcacttgtcttattgatcttagccattctgacagatgagatagaatctcaaagttgctctcatttgcattaccctgatggataaggatactgcacatttctttaggtgtttctcagccacttgagattcctctctgtgtaacactttggatgtggaatgtccttctgaaagacccccgaagatgtactttcgtagaaggagacccgcacccaggaatcagcgagaccacagacttggatgcaaaaccgcaagaggttttattagagacgcgggtacccggggcaacttagcttctgtgtggctaagcgcaccgagccaagggaaaggggtccttatatagggaaaaaggcgcaagctagaagcagggattctattggataattctaatgaggcattgtacagagctattcccattggtcaatgtaaatgaggcgctatacagggttattcaaatgaggcgaagtatagagtcattcaaatgaggtgaaacacagagtctttcaaatgaggcgaaatacagaatcatttctattggatggttcaaatgagacacagagccattctagatcagcatattctcaaggtctggtgtctggtacaacagactcaattcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagacagaggggcagggggcatgcagaagcattccgagcgggtctttcacttctgtgtgctgcaaatgtgatccacctgcccctgcctatgccaccactgactgacttttttttttttttaatgattctatttacttttttttaatgcacattagtcttttgcctgcatgtatgtctgtgtgaggatgtcagatccccctggattgaagttatagacatttgtgagttttcctgtgggttttgggaattgaacctgaatcctctgaaagaacagccaatgctcttaaccaggtatctcaaactgacctggaacttactatgcagcccaggaagacattcagtttctggtcctccagattttaggtgtactatatctagtttactctgtgttatgttatagattgagcccagaccctcttgtgtgcaagacattctgccaactgagccacattcccagtccctcagtataacatgtttggatccttttctgatcatgcttaaggctgggcagctaaacactgtcaggtaataaacatggctgatctgaaaaacaaacatacaaacaaacacagaaacaaaaaactggaatcaatgtttcaagacggagtttctttccagccaggtcctgcacctaccaattctaatctgaataatatatacactcaaatgtgtttagcctacgaacacaggtttgttgacttggaaacggaatggtgcctgtatgtcagctgagtgtggtccaagaatctgccgacaatgacgggagggacttagtatatcaccattatacttcctgtgcctctggatcttccatggacacttccatctgtggcaggaccatagagcaaagttgctgcgatctgactacagataggagaaatacctcactcacctcctgagagtcaggggcaggttcggacacatctgttctcttggcaccagagcagctggtttacagcaataaccccaagatagcaggcctgagagtcaggctgaaaaaccaacaaaacagggctacagcagagcactggcctaacaggaacaaggctctgggtttgaccatctgtaccaaaacaaacaaaagctattggaaaaatttaaaaacaataaaacaaaagtcgtgaagtgtggtggtgtgctgttagaccaatattcacaaggataaggcaagagtgtgaagcccacaccaggctacataaggaatttcagggtaacctagactatatagcaagaccctgtctcagaaaataaaaccaaccaacaaaacaaacatgagtcccttaatgacattacattcaaccttttcccagtacaccaaaacccaaaacatgtcaccttgtcatctagatggcagaatcttttttttttttttttcttttttccccgagataaggtttctctgtggctttggaggctgtcctggaactagctcttgtagaccaggctggtcttgaactcacagagatccgtctgcctctgcctcctgagtgctgggactaaaggcttgcgccaccaccgcccagcagcagaatcttttaaagtctagtagtttactggcctgaagggccccagtattggaaaataaaaaacaaaccccaaagcttcttttgtctctaacatggccaatgaaaaaatattaggggctggagatatggctcaggaattaagaacactgcctgttcttccaaaggtcctgagttcaattcccagcaaacacatggtgactcacaaccatctgtaatgagttttggtattgaacactgtacacataataaataaataaatcttaaaaaaatattaggattgttaagctccttttaaaatacccaagaatttgcataccttgctatgttgtacctgtggtttaattttgttttggaacaaccttggaaaatagcttcctagccaccccagagaatgaaagatggtcaggtcaggtcatgttgtaagtgacaaaactggaattcaggagaattctttccctccaacccactcccttttgtaaaaattcagccatgagtgagtagtacagtctatacacacaacctcagagcatcagacatcataggagtgcgaggagtacccaggatacctgggtgcaaacagtacaggcagactgcttttctgtcctcctacttgtctctagagctcagggaccactgcattccaggccagcaggaccctgtgacagataggccaggccaagcctagggtgcccttgggcccttagtgtgtgtggcaggggtgggggtggtggccctgctatgcaagttccagaaagtgaaagctgcaagaagacacagacacgaggctccacttttcagtttcacttttgcagggaccacatgcacagggactgagcgatcctgaaccaccctggaaggtgccctctccccactccattcagaaaatcggagtgcgcccccagtaagtggctgtccgagtgcctgttgacattaagtgaatccatgtgtctcagaacaaggattaagaggcctggggagaatcgtgccaacttccttcttctcactacaagtgccacaatctagaggcttcgttatggactggacactggtcatttataggaaagaccacagctagagatggaagatccagacattgccagccttagaactcaggacagtgaatcaggtgtggaggcaggcacgggttccgtaacagcactggatgtctattactgagtaattaactttccaaacactctagtttaggacatcagatttgcttggttgggctctgcctggctgatctttcctgaagtagcagcgatgctgcctgctgggatgccccttagtagagaaagatcccattccaggcccactcacaggaatggtactgggattcctttttctgagtgctgcaagaattcctccactgctcacaggcaaaggctatgtggagcaagggagaacagcaagagaaaacaaaaacaaacccaaaaaaactacagttcccagataacccagccttcgagttcacatcccattactattttggtattcttttattcagaattgcaccaagaaacagtgccctggagggaagaggattatgcaggagctgggatgccaggagacatcacagggcccacagaaatcacttgggagactgaaggttgtctggggagtgacaggactaattaagtctgaagaaagagcaggaactaagaatggctagggcagtgaacacaggcatagttcaggatggttgagtggagaggtacctgcaggtagagatgggggtatgtagagcggagccacgcagcgccagagcttttagagaaggagagcttcatcctggtggctacgtggaataactggctattaaaatattaaactggggtgggcatggtgaagcatgcctaaaatcccagcagcactggacagactgcagaagcagggggatctctgggagttcaaagccagcctggtctacaaagcaagtttcaggacagccaggaactgttgttacacagagaaacactgtcttgaaggcaaaataaagcaaacaaacaaaacattatactgctttggagaggatagattgaagggagtaaaataaaagagaaagccagctggctttgctggcacatgccttttatccgggcacaaaaacagcctgcccctcaaaacaaacaacaaagacaaaacagagacagagagagcaccaataagtcaccctaaatcaaggtagtgattaaagaggcagagtgcaatagggatcaaatttagggccgcatatgtgttcagcaagcactctaccaactctccagccctgttctgagattgggatttggtatactggccaagctggtcacccctacactcgaggactcctcctctgactctttaatgctgggattgtgagtactgcaccatgctcagatgaaggaattaaaggctttctggtttggggaactaggcaaaggcattttctgagatgaagtccatggtcaaaagtagtctatgttgagaggtagatgaatgggatagaagtctaggcactcctcagaggaatggggagagaggcagactagagcatcagaagtatcacaatgccaattgcgggtaatgaaatatacaagggaggctgggcatggtggcacacacctttagttccagcattcaggctggatttatgaggttcgggcaagcagatttctatgagttcaagtgagttccaggacagccagggctacatagagggaccctgcctttaaaagcaaagtaaaacaacacatacacacagacatagacacattaaataacaaacgtataaatctaaaaaagatatcatctttaaaaacagaagaaagtcttaaatctgtcaggaaactcagtaatgatggtgatgccagaagagaaccagacgggtgtgtgtaacagcactatgaacttgtgagagctaaaatacctgaaaatgaaagcccatggagaatgtagagagagaagaaaagcaatgtcttagaaatgtaaagcattactaaataccttagaatttataaatataatttccaaacctcattaaaacaacaagccaggaatcaggtatgatgacaagtcctttaataccagcatccaggagtcaatggcaggaatatctctgtgacttcaaggctagcatggtctacatagcaagttcaggccagccagcagtacacagaccctctctcaaaaacaaaaaaaagcaagctgaaaacaagtcaggagctggagaaatggctcagcagccaagatcatctgttctctcgcagacggtctcggtctctgttccgtcccccacatggtagctcacaattgtccaggactttagttccagggaatctgatgccttcttctcatctccttaggcaccagacttgctcgtggtacacatgcatacttgcaagctgaatgaaaacaaggaccactccaaggcatggttaggggaagggtttttttttttgttttttgtttttttggttggttttttgtttttgtttttcgagacagggtttctctgtgtagctttggaggttgtcctggaacaacctccaggtctagctcttgtagaccaggctggtctcaaactcacagagatccgcctgcctctgcctcctgagtgctgggattaaaggcgtgtgccaccaccgcccggcctggttactgaactttttaaaaaaccgagttttgaactgtgttctgggagttggctattgaattaaagaagcacttcgaaagtatttctttgaatctgtaatgttggttggccctacagcaaaagcagtaaaagcagcaatgatgacgtttcgcagtgatttttcactttgcaacaagggaccaaacatcaagttcttgaaaacaaataaacaaacaaacaaaaaaaccaaaaccatccttttctccttcctctccccatcatgctccaagaatcattcaaccatttgttatgggttgctgggctaaaggagtcatatccggatcgttctttcatttcctacttttccatttgaaaaagatacttcaggatcattctctcccccccttcattctttggaacctcccttttgtttcctctagattacgtccttctagaattgtctctctctttttattttctttagaaacatttaggtgttaggttaccatgtattccgcaaggaacactgtatttttgcttccactttctgtcttccccaagtggcttttcttgggcgaggtgctctccgtgtcttttcagaaagtggcaccatccccgcagtacttaccaccatgcagttcgcagagactggaatacttaggtccaagcgagcaagaaaaacaacccagctgcgggttggatcacgtctgggaagggcaatggacagtgccaagatgggactttattaaacgactcattaaaactacaagaaggaaacctttgctggagagctgacgtttttattttgtgtgtgtgcatgtggaagtgaatttgcagaagtcggttctcgacttcagatgtttttcgaagtactccgccagaaaatatttaaaagacaaaatggaaagctcaccttcaaacagattttaggcatggtgaggaggacaagtacaaactaagtgcgtgcttccaaaaagccttttctgtcacctcaagctagaaactgtgcagaggtgcgcaggatgatgcaaaagcaccttccagaactttctgcgcacaaaagagtcctaaaggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcttccccctctcatgttttcttaaaaagatcgaggcaacttttgcctgcttttagtaagaagaagtcgacgtgaaacttgtcattagcagggtactgaaagcacctgcttttgaactgaagtttgccagacttgagaataatttttagtgatcggtgctgcagaactgaacacgtttaaattgcccactctaaatgaaggtctgggattcgcttnnnnnnnnnnnnnnnnntaaaaaaaaaaaacctgtaaaaatatgcagaggatgatttcggaggatttgtgtgtgtgtgtgtgtgtgtgtgtgtgtgtgtgtgtgtgtgtgtgtgtgttttgacacagataagtcttagggatgaccttgaggactctggaattggggagtagggtctttcagagatagtaaaaagactctgggagaagttgctggagtatgacaatgctagggattccttgctagcttcacaattactgggaactgggttgaccttcgagttacccctcttagacttttttcaagctaaagttttttttggtatgtggctccaggcatagctcaaaaattatgctggtttgacacatggatgcttctttggtatttggggtttgcctgcagtctagacatccaaccagcagcacagtatctgttgcttttttcctgatttctcctgtgtgttagtttgttagcatctaggtgtgtcgtggaactgggaaataatgccttgccctcttgcactgcaaattggaatcagtttttacctgtttatgttattagggaaacattcaagttttggtttaccaagttagcaacactgtaagacttgagtatcctaggaaagtccttaacaccatgtagaactaaatgtttctgttcttaaaatcaaataatgcttgtcaaagagactttaacgaggtaagagaaaaatgaaggcaatgtcttcactcccttctcgtgttgttttttgtgggtggttgggggttttaaagagcatttgtgtatttgtatctgcatacgtgaggccaaagaactacttggaggagttgggtatctctaccatactggtttaggaattaaattaatataggtggtcagtttttattggctgagtcatctaactagccctgttttaaccccccccccaacttgctatccttgtgttctcaaccccaggtataggtacatgttaggtaagtattgtaccactgcctccacaactataaaataatcccccctcccccccagcgtttctctgtgtcctggaagtctgtagaccaggttggcctcaaattcagatctgcctgtcttctacctcctcagtgctgggattaaaggcatgtgcaaccaccaccaccacctgactgacataaacttttaaatgggaataaactatatttttatgtgcattggcatttctgctgcatgtatgtctgtgagggtgccagatcgcctggaactggagttgcagacctttgtgaccttccatgtgggtgctgggaattaaacccaggtctgttgttaaccgctgagccatctctccagtctcagtggggggggaaaaatcttaagccagcttcataaggctgctttgagaacaattagcttgacatgccaagcccatagctattctctttagaaatatgtcctctggtccttggagttggtttcccctcttctctaactgaaggcctgaattggtatcccagcacccatgccaggtggccctgcaatcacctgtgtaaaggaagctttgagagacccagtgctctctcctggcagcctctttgggcaccctcacatttgtgcacacaccccacattgacaaacacataataacaagtcttttaaaaagtcatccctcacccacacgctctccccccgccccccatggtaacactaactgggaagaaaggtagcaaacacatttgctgaagtacttgcttaactgttcagaagtgtctggggttaaaaaccgacttaggatgggggcggaatgctgtgtggcacctttatgtcttcaatctcagcacctagcagaggcaggcaggcaggttatctgagtttgagcccaggctggtctcactatccagttccaggacagccagggggctacacagagagaccttgtctcaaacaaaaaagaggaatgggtacaatgggaagctgcagtgcttgggttcagtttgtccagttttttcacctgtgatcatggcagtcatacctatttcacagggttgaaagtgacctaagtgtgggcagtaagtggctgctgttgtcctcgggggttttgggtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgaaaaagaaaggcatttgttttcaaggtgagaattctctctttctccactaggaatacaaaggtcacagatacttgctattacagatattttgttccagtacaaaagctgaaaccttacctaaaataatttattttctagttgtgtattttgtttcagtctattacaagtttgattgaagtagttctaactgtaagactcatttctcctagttgctcccccttttttttttttttttttttttttctcaagacagggtttctctgttttgctttggaggttgtcctggaactcgctcagtagaccagactggcccctcgaaaagttgctcccctcttgacataagaatgaaatgcttttctaccatttgtaatgtaaattgtttaccattaataatctaagcaatttatttttggtttacattttctggaaatcttttagaaatttaaatattcaggaaaaactacttttgaaaactttaaaaaaaattgttcacttacgtttctaaatgtttttcatgtgttaatgtacatgtaccaggtgggtgcctggtgtctgcagagatcagaagagagggtccctagaactggagctaatagatgtttgtgagctgctgcaacatgggtgttaggaattgaactagggtcccactggaagagcagccagtgctgggaagtgctgagccatgtctgcagtctttttcttttaattattattttctctatagtggtcatttcttccgtctctgccctttatgttcatctttgctatcctactttctttggtagtaagcaggtgcccatgtgtagagttagtacttgggtataatgcacaacgagcttccttgtcctgaggcaataacgaagtgaataggtaaatgaaatcttgattgataggtaacagctggatgttgtggctcaggtctgtaatcttagcacctgggagatgtaaatgggagaatcaagagtttgaggtcatcttcagttgtgtattgagttcatcctaggcacgtgactgcttcaaaacaacaaaattgggctgagcagtggtggtattcacctttaatcccagtgtctggtaggcagaggcaatgccagccagggctacagagcaaattccaggacagccagggctgttaaacagagaaacccgtctcaaaaaaaaaaaaaaaaaatcaaagcaatattgaaattgaagggctggagagatggcttaaaaggtaagtgcacttgagatttcagaggacctgagttcagatctcagcctacatgtcacaacttcccataactccagctcctccatgtggatccaataatactcccttctggcctccactggtccccacacatgatgtaggtacacataaatacaaattaaatacattttaaaagaataaagacatagaaaagttttgtaaataaacttccctgagtgagggatggaaaaggaagccatctcagacagaaacgcccgcctgagctctggagtggcttgttatcaaagctgatttggccctcctggaataccagtattacaagttgtgagcagctggtaggcagggctagatcccgaaaagctttgaattccttgccaaggagttcagagcttagcctgcagccagagttggtaccctggaaggatgattaatatttgaactgtaggaagataaccatgttcgagaagttagtcccaacaaagacaggaacaagacagagaggtaaggaaagcagcataagggcctttatgagattagatgggagggccttggagagagtggtgagtaagagatcagttgactttgggacttttgtctggctgtggatcataaccaaggaagctgacactgaacaacagattaggaggggcaatagtatcatcagtttggggcattaaaggttagaatggtttggtagtcacttggttgtattgctcttcatagcaaaaggaagaagttggatcaggtcgggatgttagaatttccagagagtggactaatggcaaaatgaagtgtagaggtttcgtggaagaagcgagaagagctggtatttaaaacacaattgtcagtcaggggtgttgcttactgaatgaacgcagtcctggttccagcctgattaccacaaaaaacaatgctgaattcctgtccgatgtgttggtgtgtaatattcaagaattgggatttagccctgttttaagatggcatcaaagtttaagtaatgtttatgaagtttgagttaggtatgtttgtcatcctgacttcacattttgttagagtggattgcttacgattttcctctcataccttccacttcccaagttttacttttcctgcagaaaacactcagttgaactcctaggatgtattctggaactggtaaagtttgtttcagtataatgtgcagatcttaacaaattgaaggaaaaaaaatgtatcttggtattttcatacacttggcaagaagtgagatttcaactttatattgccaaagggccagtagaatcagaaacaatttttggtttttttcaaggcagaatttctctgtgtagccctggccatcttggaacttaagtgtagaccaggctgacctcgaactcggatctgcttgcctctgccttcccagtgttgggattaaaggtgtgtgccaccatactcagctagaagcaaattttgctctcaaaaagatttatttttatttatgtctaagcgtgttcatacatttgtacttaagtgcagatacctgaggaagtcttcctctggaagagcagcaagtactcctaaccactgagacatttctccagctccctaaaagcaatttcttaattgtgaaaaagtggtagataccctttcaccatttactgtatggttacattctgtaactaataattgtaataattgcctcttaaaagcttacaaattccccaaaccctcccacatcactcttaatctagaattgggtgggacagttttttttttcctttatgttgtgcaaatgggcagactttttttttttaaataccatctaaattccagaggcctgggtttgtgatttaatttttaacctgtgctgtcctagtggaagacatgtttatgagtttggacccctttcttgtaaagtgcgttttagtaggctctgccaaattcaaccacagttaaaaatgcttaggcatatagatagcttctcagagacagagtacatgtttggaggtcttggcaaacaagtggggtctacaacctcatacttggcttctaggcaaattaaagtccatcactttaaaagtgttgaggtaaatttggaagctttaatgcaggtatctagaaagaaggaggaggaaacaatattactctttctctccagctttccctaggcactgatgtggtgtttcattgttggacaattctgcagccaagtggcctagcaatgggggaagaaacaaagcacttcttctgttgaccctttgagtgaagagtgttgctccagttctgtgtgaacacaggtgttaaagagcacacagttgattaaaatgccagcattaccagttgcagcaacttggggatccccataccctgtggttttcatgttgagtttcccatctttggatttttcttggttccatttgttttgtccatacttgtcctttgctgctttacaagggttatactgttgtctgttctgtagtatctgcagtggagtggattgtataacaggtcagtgtctttacatctgtttttgttttttaaaaattttcaagatagtgtttctcgtgtatagctctggctgtcctggaactcttgtagaccaggctggcttcccagtgctgggattgaaggcatgggccaccacagtctggctccatctcttttgcttttaagacatttatttaagctctctgctctttcgagttgttcttcaggtgaatgaaggtgcaatataataacatctgggttgtggtgctcttggttaggaatggatagcttgtagaagagaataaagcaaaagtcaccttcatgtttgcattccctagaggacatcaatattttcagctcccccccccccatagggtttctctatgtagctttggaggctgtccaggaacttattttgtagaccaggctggcctcaaactcacagagatccacctgcctttgtctgccaagtgctgggattaaaggcgtgtgccactactgcccagcgtaatttattatttacttattttttgacttttaaaaacaaaaatgtattaagatgtataacaggctccagcataacactttattatagctatagacagagaatccatatatttaaatagtggaagaggctcaccctaggtacaaggaacagcctacattttactgtatttcttaattttaaccctctatggctggaggggctgaagggtgctaacctgaggccttggctttatctcctccttgcctgtttcaggggctgcttcttgccatctttgtgactggacgtgaggcctgtggtcctttccccagaccctgatcatcctctgttgtattatctgagacaccaaagaaggtgaacataaaagatgctttgcctcattttttttattgttttatgtgtatgtatgtacacatgcacgtgctgccttcatgtgtgtctatgtaccacatatgtgtctggtgcctaaagaggccaagagaaaggtatttgattgtctggagctagagttaaatatgagccactgtgtatgtgctaggaattgaacctgggtcttcttaactgctgagccatctctcctgttcctcttttcttattttgcataggctctcatgtagcccaggctatcctggaactccctttgtatagtaatatttattgatcttgactacagtctttctgccacccattctgggttacaggcatgttgcacacacttagcctttaattatatgtgtgtggggagttttagatcccctggagcagaagttccaggttgtgagcccaccctcttgagtgctgagaatgagagattctgaaccatcactccagttcagcccttccctttcataggggaggttaactcactttggtggtggttgtttgatttttgtttattgagcatagtatttatagccactcatcctgtgatttttatcagctatttactttgcaacaaaatgtgttaagaggatatttatacaagaaagttggaggaaggagtctatgttgaatggatacattattatatattaactgtttattgtggaataaactgagaaattatagcttgtggtttctggcatttatgactttcagatacaatttgtcataaaatttgttgttgtaaatatataatacagtggctaggtttgttgtcatcaccaccactgtctataactttagaaaataagtgacaatttaaagtcctttctaagtttaattttctcctgtccctcagacacacacttacattacagatgagatcatgtggtgtttgttctactgtgtgctgcagtggacttaccctcagtcaggaagcaggtgattgcttgtggtgcagaatggtggggtgagaatgctctccaggacagacaagatgcatagctgaccaagctgtttgagcaagtgaggcagttccagaggaaccacaaactcacaaatgtgggacttggaaagaagtgaaaaacagctaccaggttgcttgaaataccagaaatctcaaaatcacaaccgaactgtgccagacccacccaccaccttctcagatataaagctgatgggggggggggctgtgctgttttctggcttcactacagagactggatagatgtttttggttttgaacataagtgactccataggttttgtgaaaataatttcagttaattccccagacctcagaatggttaaatacaaaccaccacttaatggggctgctataaacaaaggttagagtgaacacccctgtgaatttgctgcagattcccaggttgccccttaaggacatggaagagctcagaagggactaatagagttaagtgatcatccagtaagagacgacctgggtgcccttcgaggtgttaggatcttgcttcatttctcacagtatggaccctgggtttctctgctcccgccctacccttgttcaagtaaaagctagtccacaggaatgtggcggactgtcaaagactcatgttaaaagtcttgatgggctggtgggttgcttttgtgtctatcctcaccaagaaaatgactgcttggcctcactgttgagcagtggccatagcatttctccatagcttgtcagggttgtgtgaaatggaccaaactggcttctaaggcagcgagcctcacagctagaggcagtctggatgccctgtagttttggcatggtgttttcctgccgggaagggaggggactgtgagggtagagttagtagaggctggcatggagcattgtgtgtacttcctttgtccttgctcatgaagaggctgaagtttcctagctctattgatgattgtaaggggaactgtggccttttgaccttgatgaccagagtgtttagagcagacacaggaatatacatgtctactttgatactgttttggctaaagtgacatggccatttgcttgggaggactttttcctctgaattcagttaaaaagaaaaagtctcatcttgtgtctcattctgcagatttttttctttttgtattatgtagagtacttttcccacttctaataatccagctactttttttctgtcttaatggtttttacacaggtagctattagtgtagacttaacacaggcagaggcaggcaggtctctgagttcaaggccaccctggactgcagagtgagttccaggataaccagggctacacagagaaaccctgtctcaaaaaaaagatatacatgcctctggatatttttggttacgtgtgaacctgtttgtgccttgctgtggtccactgaatcacagtgggctcaggcaagagatgacatagtggcagatgggaagtttcattgctcatatatttacttctaaaataatataaggatggttttgtggttataattccagcactatatgtgcaaagggaattgtacttttttctttctttgcctgatatttttgtggtaattggtaattgggtgtatgcatcctgtgattggcccattggggtttaagtttccatgtttattttccctccacttgtcagatcaggcttaccttgaactcagagcagtcctgcctcagtctccctagtgctgggactacatgcatgtgtgaccaaacttagcatttctttgtctttttatgcctcctaatcgagatctggtaaagttgaccttagatatggagtctcactggcctctaacctaaagatagtttttaccttccttagtattgggattttgaccagggtagttaatttcagtcatcatttctaaactctaaggttgtcatatctgtgattttcataccttcctaaaggtgactgtatagaacttcagttatcaaagaacacaccccccacttccacagagcacagccgatatgtggagcctcttgtgtcctgggaacagagtggtcatagtgaatgcacactactttcccagcagggagtttaaagttttaggtacattcttaatggcatgtgtgtatgggggtgggcacagtagtaaagaaagtgccaacatgactgactgctccatgatgtggttaaggtttttattagatgaacagcagccagcaaactgggcatggccagggttctgtctcttgagtattgtggtatagttagttcctatgttgtgtgatataagaaacaaaggaggtagtggatgcctcctagctccaggtattttcgaatgttttgtatactggccctatggagtagtagatctggggaattcttgtagtttgtttgacttggctataaaattgtatgtgctggaggtagggtggaacagagaaaagtccttgcatcgtttcttgtcatttcccttaacaaagctgtgccaattcctttgtctttacaggtattgctcagaagaaaagatgtttggttttcacaagccaaagatgtaccgaagtatagagggctgctgtatctgcagagccaagtcctccagctctcggttcacggacagtaaacgttatgaaaaggacttccagagctgttttgggtaagattagttatggtccctcccccaccccattacccctcactctccaccgaggcagggtttctctgtagcttaagagcttgtcctggaactggctctgtagaccaggttagcctcaaactcacagagatcctcatgagtgctgggactaaaggcatgcaccaccaccacccacctgtattccattcttagagggaaaaataatcaggattgtgtggaaatgtttccatgcaaagcaatggaaacaatgtgctaatatttaaaatcactagttttctattatttgggttagggaggattcatattctttttggtttttcgagacagggtttctctgtggctttggaggctgtcttggaactagctcctgtaggccaggctggtctcgaactcacagagatccaagtgctggggagaattcatattcttaaaatgaatctaattagctgtgaagccctttatggttacagttgggcaaacccctttgtccttaactgtaggatgtacaagtagattttcaaaatgtatccttactctcttaccagtagtagtcctccagtgttgtcttcacattgtgtttgtctccacattgagttacattttaatttgcggaggataatagtttgccctggaacttaaccccagggtatgttaactttccaacagatacttgggtgaaataaaatatttaatgttgaaccatttcctatagtatgcttgaggaagagagagtgcatatatatgcatttgcatgaggttgattttgattgattaaatggtcactttgtttttaagacagggtttttctgtgtagccctggctgtcctggaacttgctttgcagaccaggctgacctcaactcagagattctctgcctcctgagtgctgagattgtaggcatgaatcactacagctcgtactttgtacactggggctggagaaatggctcagcagttaagaacactcgctgctcttctaggaaccctggaaccctggttcagtctccagcaccctgtggtaactcaactgtctgtaattccagtttgaggattgaggagatctcttttttttttttggtttttcgagacagggtttctctgtggctttggaggctgtcctggaactagctcttgttatactagggtggtctcaactcaacagagatccgcctgcttctgcctccggagtgctgggattaaaggcactcgccaccaacacccagcggtttgaggagatcttacttcttctgatctctatgtagcaccagtcacatacatagtacacactgatacacaaataaataaatctgacttggttgattttatttatttattttgatttgtttatttattttggtaggctctcactgtgtagttttgcttgtcccggatggaactcactatgtctatatgccaggcaggctttgaactcacagagatccacatgtcctgcgtcccaggtgctgggattaaaggcgagcaccactacacttggctttaaaaagatttttaaatggaatgtgttggcatgattgataggtctctagaagttaataatttttaattgaaaatttcatatgcgtgtgtgttttgatcaaatctacccttctctttccttcccaccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacctctatgaatcataagtggatgtatttccccaagagaagtatccacacaggaatcctcatgagggaaaagcatgataactaacattctgttttcttttcaggttgcacgagactcgctcaggagatatctgcaatgcctgtgtgctgcttgtgaaaagatggaagaagttgccagcaggatcaaaaaaaaactggaatcatgtaagttcatctctctctctctctctttctgagacagggtttctctgtgtagctttggagcctatcctggcactcactctgtagaccaggctggcctcaaactcacaaagatccacctgcctctgcctcccgagtgctgggattaaaggtgtgtgccaccaacgcccggcttgtgcttactctttttatgtcgtgtaacagttaaaggtacacacgagccctcagacactcttgaggataaaactgattcttaagtaagcatgggcctaagtggtgttaaatattcagtattttcttgcaggtgtcacactcaagggcaggacccagtctaaagacaacattgaaaccaaagaaagtgaaaactctatctggaaacaggatgaaaagcaaccagatcagtaaactgcagaaggagtttaaacgccacagtgagtttgctgttgagtactagtgctgtttcagtatcttaattttgactggggctggtttacagtctgtgtgaatccatttcttacttactgtctactaagttctgaggtggtcgccttccttttaggagtcttagcctttggaaggcactgttattgactttgggaatatgttcttatttctgtgaaatataactctgatttggtatcttaaagtaactaaaggggcttgggatttcctggagtagataaatagcttgctgcaaaaaacatgaggacttgagtcagaccctaacacccacataaaagctgagtagagcttgcaagggagcttatctggaaaggcggttgctgcccaggcctgactctatgaccagtgtgttaagagagaaccagctcccacaagttgtcctctgacttctacagtgcaccataacatgtttatgcctgtatacatacacaaatcaatgcatcaacaaaaagctgggctaacacgcttgcctgtgatcacagcactcaagattcagagattagggttccctgggacagggtgtctggcagtgagcactgggttcagtgagagaccctgcttcagaagccagtctggctttcatatatcatgggtgaacatgtacacggacaaaaacaacattcatagtctctgtctctgtctctctctctctctctctgatggcatgtgagtgtcatttgtactgactttgtagactgtcagaggaggttgtggttatatattcagcttagactttgaaaagggaagccccctcttattactacctgtttaactctcaggactcaaggcaaaactgctggattaaacacatgagtatttcataataagaatgtagttgtttgcagtagaaagaattgctgggttgttatctttttattcatttagtgtgagtcactactacaataaagataaatgtttggaggttctgattcaaagagctttgctcatgctctcttgttcgtgcctaactaatccttacctaacaatttcagttttacactgtatgtagttgttatatatcttggtgtcccaaagtcttagattaaacctaaggatgttgcagcttttaaatgtaaaaatggtatacactgaaatttcaaatagtttcaaaaaccctgagcatttacagtgatcctccctcatgtagaaactgttgatgttattgtgaggtttaaatatcctgctagatcactcctttcaggtaggattctcttgaaaattttttcttcaggaagttgaataccatttattaaagtgaattagcatattaataacacatgatacgttataacaatactttattttagatgtttaattttacagtatctatgtaagcatgctttaagaggaacttgtaagaaccttgtgattgtaagcttatttttccttgtaatggtagagctcacacccagagctttgtgccaggaaagcacttcactactgaactgcaccccctgcccttgtgagcccgccagaaaaaatgttttagtgaggtcggagtgatggctcagcgtgctactcttgcagaggagcttggtgcccatcaagcacccttaatttgctagctcataactacttctgactccagctccagggcattagataacctctggtcactgaggttgtatgcacatatgtgcacatgcaaaattagactaaagctttggtgtttaataaatatctaataattgtttctctgagttagaggactgttctatccatttcctagatagatgggaagtttaaatggtggtcgtgatctcctcagtactacagcacagtgactgtcaaccaaaaggttcattttctggcatttatttattcattctctggccaccctggaaatcacaatgttgactaggctatccttcgactcagatattgaacccacagatatggtgtgtaccacatgccctgatttatttcctggcttctaaatgcatggtgtggaaataatgctggtgtagctttaggctagtaaatcacctctgttccctgagttattttcccgtatagagaagtcagcagcacctggactttgcacgtgatgacactagaaatgtcttctgtgtttaatgcagactctgatgctcacagtaccacctcaagtgcctcgccagcccagtctccctgctacagtaaccagtcagatgatggctcagacacagagatggcttccagctctaacagaactccagttttttccttcttagatcttacctactggaaaaggtaaaaacatctgttcagagtcaccacttcatctcaaccactagctgcagtgttctatgtgttatacacagttgaaaatatttgacaaataactggtggtacaggtaggaagttggatttagtgggctttgatgagactggatgtaagacatacatcaaggttcttaaatttatgttgatggggtaaaactagctattctgacagctctaaaaagttatcttataggtgtcttgttttcgtttctgcttgctgtgataaaacacatgtgttttttttgtttgtttgtttggtttggatgttttgtttgtttgttttttcgagacagggttttttctctgtgtagctttggagcctatcctggcactcgctctggagaccagactggtctcgaactcacagagatccgcctgcctctgcctcccgagtgctgggattaaaggcgtgcgccaccgatgcctggttaaaacacctgtgttaaagggtttattttagctccaggttgtggtgcctgtcaccctggagaactgtccacatcactgtgaagagcagagaggatgtcatttgtgcttgtgctcagccagcattctctactcttcacttctaggatcaatgccacccattaatggacaagttttccgacttcagttctagattgtgccaggttggcagttaaaactgtcatggtgacaggggacacccaggccatgtaaaatgtagatatgtggccagataccaaaaagagacaaaataattagaaaagagaaagtattttcaaagaaaaagtaggatccctaggacacagaaaacatagataagacattttacctgtagacatgtctagagctacaaaatatgaaggacagtctaggactttacggagaaaatatactgctttcacaggaacacccaagatgcaaaggtgaattctttgaaacattcataaaacaatccagaaaccagtatattaatgtcttcagacggctaggagatagctctgatcgaggtgtggtggtctttaatcctagcactagtgatatagaggcaggtggatctctgatttcaacataagagccaagaaaattacattagataaaacaaaataatagaaaccaacccatataaatgaaaatgaaagtatagtgctacttgcagcactgaaaggaacgttaactgtgttagcttgaggttgatctttggtctcagcactggggaggcagagacaggatcccagggctttgctagtgaattattctagccagggtggtgagcttcagttgaggtattacctcaaagtaaaggtgaggagccactgaggaagacatcccatcctgaaatctagtttacacacacacacacacacacacacacacacacacacacacactctctctctctctctctctccacatcaagatgtannnnnnnnnnnnnncgtatgtcaagaaaatagaagctgtggtgttggaaagatggcttggtggacaaaggtggctcctgttgaacttgagttctaaaaatctgtgctgttaacatatcttctcctttatttcagacagaaaatatgttgtgggatcatctataagggccgttttggggaagtcctcatcgacacgcatctcttcaagccttgctgcagcagtaagaaggcagctcctgagaagcctgaggaacagggaccagcgcctctgcccatctctactcaggagtggtgactgaggttcatgcagaagggaacaaagagcaatttaaactttgaaaagaccacaaagcaacagactgaccctcctatttttaacttggatacctgctattctgccaaaagacattttctagaatagtttttaatgggttacccatccccccatccaacaaactcggaagccagttctagcttactgcaagaagagagtgtacataatatttaatatgctgagtatttcataggaaggctgaatgctgctgtaaagtgctctttaagtctttttttttttttaatcccctctaatgaatgagattaggggggtttcaggggacagagatgggatttgttgtgtgataaaccatatgtagtttagtctttctgtggagaggcagtggttggggcattttaaatggctggctacacttgttttcccctcatggtaatttgtcataactcagtagcacgacctgcccctagaagtagttaaagatttttaaatgctaaggcgttgccaaggttctgatgattcagacctgtactactgattattaagcaggacagactgagctttctgcaaatagcttgaaggaggaagcaatatctgaacacacaggtagcactgtgttggctcccttcatggtaatatttgataaacgtcgttatgtgagtcttataaaacagaaccaccggggctccttctggggaaggcaagcctgtaggatgggcaaggtcctatagggatagtaccaaagcatcaccattcggcagagaacgcgtggttgtaaactacttaacagattgtgtgagtcctggggatgcgcggggcacagttgatgctgcttggggcacatttcttagagggcttgcattgtgtaaataattgacattggtgttacacaactgtctgggattcactgaaatccacacgattcagttctagctctggattacctcagttgacctttgtggaggttttatctatagagtagttctttgccttgtcataaccttattagggttttaggttttgttgttttattgttttgggtttttttctctcccactatttaaagttgattagaaggaaaaagagttgtgtgttgaggctgagttggttgggttggcttcttggagttgggcttctgaacatcaagatggctgaatagagctcctcacattgagatctcagcaagggcctctcagtagatagagagagccctgtggaagttgtctgatggccgattctcaaagttcaggaaaaacaatagtgccatttcagacctctcctagagggaggggggtatgtggctgccttagtattcctcactcatgattattttaaaaactggatttttaaagtctgttagttttcacaacagggagggccgcagtttgtggcatcctatagttgtgtagtttttacattgtgtgtctcttcccttttgggaaaaacctacctagtacaagccaccacatgcacagacggcccagtgagtgggtttgttttccacagccttggtgtgttacagagtccagccattaccattctcctgcgttactttgacatgggattgtttttgtacattttggctgcagtattggtggtagaatatacttttgatggatcatctctacttctgtatttatttatttattactagacctcaaccacagtcttctcccctccactctctgcctgtaggatgtactgtacgtagtcatgcactttgtattaatatattagaaatctacagatctgttttgtactttttatactgttggatacttataatcaaaacttttactctagggtattgaataaatttagtcttattagaaaataaaagtagctgttttgtgatttttgttttgaaggtctctggtagcaatgttttttaggactcggagagatctcagtttgttaaaagcactgactgctcttgcataagacccacgttgggttcctagcacccatatgacagttcaaaaacatctgtagttcgagttccagggcctctgatgcagtctggtcttcttgaggacaaggccgacacatggtgcacagttagaggcagacagaaacacctagctcccacaattttcctctgacttgcacacatatgctctgtcacactcaggccatttccctgtccttagtgtgccaaggttcagagtgcctttctatacagaatgtacttctcagactatactacagcttaagaaatagcacattcctttttctttgagctggaaagtttgtgtggactgtttacttcttataatcaagaagtaaacacacttcttagtgtgttagggatcagaatgtccacttagaaacccaaatcaggcaggaactgaagcaggcaccgtagaggaagactgcttactgttttctttacaacccagtaccacctgctcaggagtggcactgtccccagtgggctgggccctccaacatcaatcattcattaatcaggaaaaatgtcccactgacttgtctatagggcactcttattaaggctgccttagttattgtctgttgctgtgaagagacaccacgaacaaggcagctgtcacaaaagaaagcatttaactgggagcttgcttacagtctgttaatggtggcacacaagcaggcatggtgcttccaaagtaactgagagctttacatacttagcagtagacagtgggcagaaagagacacgacctagcctagggttttgaaacttgaaggccctccatcttcaacaaagccacatctgctgacccttaccttagcaggccgaactgggaaccaagcattcaaagatatgaacctatggcaccatttttatttattgtcaccacagaggcaataagattcacttcccaaatagttctaggtctgtgaaatgggcaaacaaaccaactaggacaaattgtgatcgaacatacatgaatcatcatcatttttaagatgaagctctaagtttagagtgggtctcttaatttgtgtagcaaataggaaagtagatctgctatgaaacacctatgagccctgtaactttaaacatggataaaacatcctgtgtagttgtcttagttacttttctgttgtgaagcgatacatgatcagagcaacttgtaagcatttaattgggggcttgcttacagttttagaaggttgagtccatgaccactgtggtagggagcatggcctcaggtaggtgtgaggctggagttgtagctgagaagcttacatgttgagacaaccatgaactggagtagagagacttaaccaagaggaggggaaaggatgtgtggggttttgaagactcaaagcccagcttcagtgacacacctccaaccaagaccacacctaatctcatactctgctgccgcacaagcattcaaatatatgagccgctggggacattctcattcaaatcaccacaaaaattaatataaaacaacacagggctggagagatggctcaggggttcagagcactggctgttcttccagagtacccaggttcagttcccagcacccacatggcagctcactattgtaactccagttccaagggatctggcaccctcagacatgaatacaggcaaaataccaatgcatacaaaattaaaataaacctttaaaaaaaagcaaagctcttgcagctgagtagaagttcaaagaagagtatactctgcttttatgatttgtatttgctttttttctttctctctttaaaatggtttctctgtagctctggtagtcctggaactcactccataccaggcaggttgtcttcaaactcagaactaccctgctctgcctccccagtgctaggattaaatcatgcccagcagtatttgctctctttctttttaaataatttgtgtgtaactagaaaccccagggtccctcctgcctccacctcccagcactgggattatagctgtgccgcactgtgactgtggggactgtttgtgaatactagggatctaaactcgagacctcgagccggagtcctagatttgttgttgtttgtttgagacagagtttctttgtataactttgaagcctgtcctggtgctctgtagaccaggctggccctgatcttacagagatccatctgcctctgcctctgcctgagtgctaggattaaaagtgtgtgctgttactgcctggccctagtttcattttttaatctgatcttggaaaagtattgtaaagcttcctggtggtatacacctataatcccagcacttggaggtggagacaggcagatcacgattaattcaagaccacctgaggtacactgaacgagggccacaatggacagcctcaatatgtagccagaacttaatgcctgctgtgtaatgtagggctgaagctctccaaggaccctcttagaacagtgacccaggaaaggtcaatgaactgggactggaaagggaggagacagccaaattggatcaaaggtaggtaatttcacaggctcatttgtgaaagaaaggtaccagaggatcctcttggttgattatctagctgtggagtttggttactcatagttggtatcatgttccctacaccctgagtaaaggctacttattgtagtatgttgagtctagaggccttagacaagcccattcatttgggtagaaagtgactaaaattggagctgcccttttgtctccatgtctgcaaagggggaaatggttctgttttagaatgtctatactcatatagcttacctacacttaacttcaggtgtgggaaagatggggtttatgcttgtgtttatgattcagtctcaataatagctcagcagcctcaagttgtttagcaggtgtgttagaaaaggaatcaatggtgctgttgttttaaggaacaccgtatgttcctggtcgtgagctgctttcacaaactccctgttgattgtccccaccactcaaggtccctgctgactttgctgtgggaaatggcattacaatcacctctctgcaggtgacctcaaagggcccctgagctttaacaacaaattacaaactcagctttaattagcgcagagttcgcctggcctcagactcacaaacttggctgggggcacaggatgtaatccccaaattcaataacaaaaccatctcatagattgcaaatgggctaaattactgagaaggctattggggaagagcctgctactgctgtccataaactcagtggattttcttcccgtgcagtaagatagatacgaatgcccaccaggtggcgctagtcatgaaacccgaagaggacattgtaggcatcttttttaaagacaaggcctctgtgaagctattggaagatgagggaacctttaggaggcagaaccaagcaggagaaaggtaggtcattggtggagctccctagaaggagacacggatcctgaaaatcctatcacatcagggcctccctccccccctcctttcctctctgttcctcatcttcttcccctttttccatttccctagcttctgtgttgaacaacctcatatccctgcagttctgcctcttcgaaggcccccaaaagcagtatatgggttgaaaccaaaatatacttttccttttaataaactgacacttttcaaggtattttgtcacagaatgcttacatacctttaagaaataagtaatagctaccttcaaaactccttcttgataagtacaagtgacagaccaatataacattttgataataaatcatttttattttaagacagggtctcaaccaggttggtggtggctcatgcctttaatcccagcattcaggaggcagagggtcaaattccagtacagccagaaatgttacaaagagaaaccctgtctcaaaaaaccagagagagaggaggggttggggatgggaattaaggaaacactttcttaaaaaataaaatactttattgcctttattttagataaactcactgaatggtcaccttcgtgttttaggacaaaagtgtaatctgttgcttcacccatagttgaattattccagcccaaatgtaaactttaaaaatgattttgttttggggctcgagagatggcttagaggttaagagcactagctagtcttccagaggtcctgagttcaattcccagcaaccacaaggtggctcacaactatctacaatgagatctcataccctcttctggcatgcatgtatgtataataaataaatcatttaaaaaatgtaaaaaagtttaaaaaaatgattttgtttcctttttattgtgtttttatatatgggtgtttgcctatatgcatatgtcttggactccctggagctaaagttgttggctgccatgtgggtcttgggaatagaatctgggtcccttgaagaataagccacactcctaaactgctgaacaaaccctcctgccctaccctcccctttgcctccaacaggatctcactctagcccaggctggcctcaaacttgaggcaaattcagggaatcctgcatgtcctagccacttggctgttgggattacagcataaaccaccatactcagtttacaatgtgttccatttgtctggccaggataatgtaggttcttactatgaaataggacagtgacagttacggctaatgcctatagcccctgaacttgagaatcaggggcagtaaactcatagcttcaaccatgacctctttaaaattttttacaaatttatttcaatgttaggtgcatgagtgttttgcctgtatatttgtgtactgtacgcattcctggtaccttctgaagttggaagaggtgttggacccactggaactggagatacagagagatcgttagctgccagatggatactgggaactgaactcaggacctctgcaagaacagccagtgttcctaactgctgagccatctctccagcccctctttcttaaaaagttattgcacttacttatttataaggtagaggtgtatgcctggtgcaatctgcaatcacagtgatacactttaaattatttttaaagagattcatatttttgtgtttaattatgtgtctgtcgtggggtgtgtgtacacattgagtgggggtgcccacagggaccagaagagggtgtacacacccttcccagacagacacataaacacataattagacacaaaaataagaatcttttaaaaaaataacttgaagtacaccactgtgattgcagattgtgctgagaatactgaactggatatattatcgtctatatcaggctttccaggctgctgtgattcttttattatttttattattatgattttaagacagggtttcatgtagcccaggctggacttaaactcactatatgtagtgacaaagagttttgaacttctgatattcccgtttctgcctctcaaatgctgggattataggcatgctctgccaaagctggtcaataccttgttacctttaaaaaaatgaatattttaaaacatttattttgtgtgtttatgtgtggttacacacatgtggaggtcaaaaaactgcccgggagtcagtttttttggttgtttttttgagacagggttttctctgtgtaacagctctgactgtcctggaactagctttatagaccaggctggcccacaactcacagagatccctctacctctgcctccttgagtgctgggattaaaggcatgccctgccactgtctggtgggagtcaggtttttgtttgttgtttttatttttatttatttattttttgagatggtttctctatgtagccctggctcaggatccatatgttgctccagtcttcatcatcaaatccagaggtgtgaggtctgctttggaagaagagaagactgtaccctgaagtagttgtaggccttgactaacctgtgtcctcgggaactgcagtatacgtatagggttggatcccagggaaagggaacagaatttaaaatggaaaagggagagtttcaggatacagcattgatgcactggctgggtgtccaggagatggcgctcatacactgtaaagttgtgccttacaagtattgatcacatgacgtgagggaccttggaagctctgctcgagcaaataaatagacaaataagtgcagtgaccgactatgccgcaatgcatggattagggctgtgttcagtacacagttaccggggaggttggagtaggaggaccatgagttgaagaccagcctaggtaatttagtaagaccttcaaaataaaagcataagaagaggagaagaaagggaagggggctaggaaggtaggaaggtggagtgctgggttagcatgtgagaggccccttggtttgatctcaagtgcctcacattgtacaggctataaaacccaccatcactcatgtagaatgggagactcaggatattgcgcgcacacacacacacacacacacacagcacacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggagtgtaggtggtagtgggatataatatcactagtggtactgggtatgtggctcctggaacaccagaggcctgtcaagagcaggatagagcttcagatgaacagacaaaagcacttggccatggacatagaagtcaggatgggatcggtcaggaggtatagctccactatcagcccataaacactcagtgaggccaagccttcccacctgaggtagatttgttgttttagacaggatctcattctgtagcccagggcatcctacatttaggccaaaatggcctcaatttatagagctcttcttgtctcaacttctccagtgctgggattataggtatatgccaccacaccattgatagctgctcttagatgtccctgccatcttttcctataggtcaaactaaacccatgctgtccaaactctgggcttctcatatcattatttagccaatgttaccgaccatatttcagaaactactgctgttgtttaatccatccctgtgtaccaacatttcattatggcccatgcagttaacctgatgtaagatcgttgcttatgtaaaatgctaagcatttcccttgcttgtctctgcttcacccttgacttacaatttttatttcacactgcagccaaagggtcttatacaagaactaagactcagattaaaacatgagatcacctaataatgctgtttaatgtcctctcttcatttcccatcacactttgaataaaaaaccaagcctcttccatcaccctcaagaccctgaatgaccttgacctacctctctgttctattttctttttctttttattttttattttattttccttctggcttgaagctcgactcacattctctctctgtctcataaaaaataactcaagcttaactccacctactcctctaagtgttcttactgagatgcacatggagcctgttctatttagaagaagggttgaaaaggataattaaatgtttttcttggatggtggtttcattcaccagagtgtgagtactggggggagaggaaggaggaacttaagaattgtgtcactagctgacatttatagggtgcttggtgctgttagcctatgctgcataagaaatgaaccctagatttagtgtttagtagcttaataaaaccttattgttattattattattattatttttaagacagggtttcacttatgtagctgagtctggcctggaagtcacaaagctcctcttgcctgtgcctcctgagtactggtatcaaaagcatataccaccatggctggcttaacacagcttttattagttcaatttctgtggatcagggatctgtttgtaggttggctaggtttctagaggcagttaaaacaccaccaggaaggatcagctgcctactcaagactgttaagtgggcgaggttccttgcaagttgttctattgcggcttcattttctcatagcctggtggctaaaggcttggcccagctcctcaccacacaagactcacaagactcactggagggagatgagattattagcaatagaaggagggagtaaagggaataaaggaaaaagggggtgggtgggaaggagaggaaaaggaagcagtatcagtgtgtaagctgatgacctaggaaaaccattggtagagtttccttctggctaacgaaaggcctgaggatgaggaagcacatgtcagtgggcaaaactgatgaaagtgactgtcctagctccagcagagtaaatacattctttgttctgactgtgttctcagtggcgtgggtgatgcccactgcagagatgagtgtacttttcttcactcagtccatagttcaaatgctaatcttttctggaaacaccttcacagacatagacagatgtaacattttttttccagctatcttcgcatctcttagcccagtttttattgatataaaaaaaaatccaccatcacttttgttatattccatgtttcaaaaggaagtcattatgttcacacttaagggaaggtgtcacacagatctgaatgaagactcagagaccagggggaactgtgtccgaagctgcctaacatagaacttgaacttgccatccttcttagcttcctgagtgcggaggtgcctggggtctactgactcagcacctgcattctcagtgaggtggctggaatgtgaagtaaaagctggattgcttgagagaacagtgggttggcaggaaaaccggaagaagtgattccctagcattgagagaagagtctaagttaacccttaggtagctcctggtgccaagaatagttattcacgtgttccttctgtaaataataagacagatatggtgctgcataccggcacttgggagagtgaggcaagaggatcacaggcctaaggttggcctgagctatatctcaaaatacgaccacccaccaaagattcaaatattttgctcatcgtcaaatagttgctggaagagtactattctgggcactgtatagttctctggctttaaagatgaaatataaattggaaattttgaataacttcctcaaatcatttgcctaactgtcatttattaaaattcgaatcctctcactattaaatgtagcactatggagtgctgtgatgttagaatataagcaatttgtaaattgtttgcacatattttaactattctttctactttgtctttctctattatctacttagcaatcaaagtgtctcctccacttaacatacaaagttagaaatactttcacagtatttgcagttaaggtccttttcctattactgttgcttttcctgcaatcaagtgcagaatgacaaaattctgttttctattttatcaatacatctgctgtgttctttcgtttggttcactgataactcactatgatttaatttcagagatgtcaaattcaatactattctacaagctatacaataatcaacttctccaaatgaaccataagttaaaaccaaatttaagccgggtgttggtggcacatgcctttaattccagcgctcgggaggcagaggctggaagatctctgtgagttcgagaccagcctggtctacaagagctagttccaggacagcctccaaagccacagagaaaccctgtctcaaaaaacaaaacaaaacaaaaaaacaaaaaaacaaacaaacaaaaaaaaacaagcttaaactacttttttcttcatttgtctacaacaaaccaaagctcggtagttcattttagtaagtacagtgggcagaattcaggagtttattggtaagaagtcttacgtagagcacagagaagacaaaagaaatcacctatttatctaatttataatttatatttggagagtataattgaaaggcagcctggtttctttttaacaaaatacttaaagtggaagaacaatgttgttctgcatttagtatttattaaataacaatgaagagaaataggttgtaagaacctacatataaagtatcgaacatctgtgatcctaatactcagtaggcagaggcatgaggatctccacgtgttcaagtttagcatggactacatattgactgggtgggggtacatagtgagaccccaccttttaaaaaaagctaaaacaaactggtgcatgcctttagttccagctcctggaactaaagaggcctgcctctgcctcctgagggctaggactaaaggtgtgcgctatcactgattggctagtataatcagtttctaaggaataaatttgacatgttgatgatttctccatttattaggccaattttataaattttcatgttgtagctatggtaacactctgatgatttatatggctatgccagagccttcttatttgtctattagaattgttaagaccttcctttacaaaaagtgctcgttatcctccaaagaacattagcatcagggattaactttaaagaattaaatatgcaagagagttcacatttgaatcctgaaaatgctctgtgggcctaaatgagtccagctggcaaagctttagtagccttgaaaccattactgtgtgactcaggttcagcttcctaaactggattacaggctaaggctggttttttttctttcccttccttcctttatcatacttcctacccccaccttccagatagggcttctctgtgtagcttgactgggcttgcctcaaaattgtggcaggccttctgcctcaatctcccaagccctgggattataggcatgtactaactcttagtgtatttctgggtacttgagtctgtgaaacatcatatccgctgaacaccacaatgtaacttggaggtttgccaggagacagatcccttgagccacactttggagaatctaactgggctctggcatagacctttgtgggttttgtttgtttgtttttgatttttttgagacagggtttctctgtgtagcccagtctggcctggaactcagagatccagttgcctctgccagtgttgtttttactaaatctcaatcattcgattttgccaataaatgctcggccagtaggtcaggcttgttactagctaactctaacaaaaaattaacccactcactttaatctacattttgccatgtggtgttacctctctttcatcttgcatttcctatttcttttttgtgtctcgctgatgactttcactctgccttcttcccagtgtccttagtctggttctcccacctaaccttatcctgtccagctattggccagccagattctttattaactgaatctcagcaacatatagtcacacagtgtaaaggaatattccacagccttttccaaaacccattgagctgttctcactggccctctgatctctaaattttgtttaaacatcaaacaaacgctacataggctgctgtgaagaaacggtgcgccttaactagaaaagatactttgtaactgagaacattatagtttgagtatacaatgacctcaaaggctcatgtgttggaggtttggccctcagctggtggtgctactgagaagtgatttggttatgaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttctggtgttaccatcatagcgaaccgaataacaatccaagggatgtaggaaggtagttcagttcaacaggactaagtagctggtgttggttcaaacttttggagtctgaccccaagtagttcatttgaatcacatttaagcacagcacaagttggtaaaaactttgctggggataattaactcaatcctatgtgtataataaagtacaaaataaagattgcatgtgactacatcgagagtctttgaacagtacatgtgaaaccttccataaagatgagacgtatagattggttacatggggaacttttcataaagatgggttcaattagctggacagtgatggcgcatgccacagaggcaggcagatctctgtgagttcaagaccagcctggtctacaagagctagttccaaagccacagagaaaccctttctcaaaaaaaacaaaaaaacaaaaaaacataaaaaacaaaaaaaagatggattcagtggattgactgataaaaacaagttcacgataagggtttgggagaagttctactttctgggtagataacaggttatggatcacttcctgtgtagcaacaaccctatgtgtttaacattccaggcccccctagtgcttatctgtgagcccaaggacctccatgcctctgacatctgggatccttttgcttctgtctctggagtgctgagatgataggtgcatgtcagctcactggctttcatggttggagcttgtccttgtccttgtctctctctctcgggatggatttcttgactgccatgaggtaagaagctccctgcaccgaaatccccacaagtccagcagacccagcaacagagccactggtctgtggaagggaacctctgaaattgtgagccaaaacaaatattcaatccttctagttgctcatcaggcattttgtcatagcgacttaaagtcactaaagtgacacttaagtaggtggggacaccaaaagcagttgtcctggagaaggtgctactccagcctggagtcctgtgtgttcctacttgcagcaacacctgttctgtctccttggatgtctgtagagaagcctgggcatctccagcggcatgaagcatgtaagtggagatctgtactcttctaagatgggggggtgtcttaataacttttctgttgctgtgaagagaccatgaccgagcgagagagaaactctgtcttgaaaaaccaaaaaaaaaaaaaaaaaagagagagagagagagaccatgaccaaggcaacttaccatcattttgggaagcaaggcatggtactacatcagtggctgagaacttacttacctcttttttgttttgttttgtgttttgttttttgagactgggtctctttacatagctgaagctgtcctagaactcactatgtagatcccacctgacaagagcttacattttatccacaggaagcaggcagagactaggtagaggtgggatgggcttttgaaacctcaaagcccacccacccctagtgacgtacatcctcagtcaaggccatatctcctaatgcttcccaaagaaccaattttgccattgaagttttgagatttcacttgggtatatgttagcatggatcttttcacacttttttcctggaaatctattgaatagatttttcagtttgaaaatccaagactttcctctttggtggccttcaagaacctttcaccggttgtatatttttctatttcatatgaaaatcagcatgttagtttccttttattttccatgtcctgtaggttgctaacctgtaggaagaatatcattctctcaggattcctgctgagattacaggaaatattattcaaataattcactgaatttattctggtacagacagtcacttcaaagctttaatgagtgtggcatgatttaaaagaggctaatttccaaaagttaaaaataatattatgatggatgacgcaaatggagagccatttatatcaaagagtcaaaagctcacttgccacaggggatatagaacttgtttttgcaccttcttctagctaatttttttcattgtgatctgtagtgtgtgtacacattccttcgtgtgtgtgtgtgtgtgtgtgtgaagacagagatcaatgctgggtgtttcctcatgttgtggaataatcattttgtactgtgaagatgtgtactcagattggtttaataaaaagctgaggggctggagagatggctcagaggttaagaacactgactgctcttccagaggtcctgagttcaattcccagcaccacagggtggctcacaaacatctacaaagagatctggtgccctcttccggcctgcaggcaacatgcaggcagaacattgtatacatagtaaataaaatctttataaaaataaaggtacatgcctttaatcccagcacttgggaggcagaggcagagacaggtggatctgtgtgaattaaaggccagcctgatcaacagagcaagtgccaggagaggctcaaagctacacagagaaaccctgtctcaaaaacaaaaaccaaccaactaaccaaacataacaaaacaaaacaaaaaacaaaaaaagaagctgggcattggtggtgcacgcctttaatcccagcactcgggaggcagaggcaggtggatctctctctgtgagttcgagaccagcctggtctacaagagctagttccaggacagcctccaaaagccagagaaaccctgtctcaaaaacaaacaaacaaacaaacaaaaagctgaacagcccaaagctaggtaggattttcggggcacagaggatgctaggaaaaagggccaagttgctagctggacacagaggaagtaggatgttcaggaggagagccatgagccacatggcaagacacagattaatagaaatgggttaatttaaattataagaactagggcaggtggagagatggctcagaggttaagagcattgactactcttccagaggacctgagttcaattcccagcaacctcatgatggctcacaaccatctgtaatgagatctggtgccctcttctggcctgcaggcatataagcagacagaacactgtatataataaataaagaaacctaaaaaaaaaaaaaaaaaagttatatgaactagttaggaaacaagcctaagctatactctgaacttttataattaataataagtctctgtgttgtgatttgggagctggatggcaggacagagagactacactttcagttgtcctctatcttattttttgaaacagagtttcttgctgaaactggaactcctcactacttcagctagagcggctggcctgcaagccccaaagctcctgtctctgcctctctattgtttagtttacagacacatgctcagatcttcatgcttgtatggcatgcacttattggctgagccattttcctaggttgtttttatgagagaggttcttactttgtagactaggttggtctccaacttgcaaagattttcctacccaatctcctagatgctgggattagagacccatgccacaactggctgcttgataataatcacaaaaagaattcaaagaacttcaaaatgggcaggtgaaaggtgatactagaaagagaacaaggcaagtggcagccagggactactcgctgctctcctgagggacttcaagggtgctgaatgggaaagcataatgtattcattccagtcctacaaatagcatacataaagctactgaaatttgattataatttgaaggaaaatatcagcccctcagacattaatcttagctgggtgtagtggcacatgcctttacccccagaattcaaaatggatctccatgagttccagaccagcctggtctccatagcaagttctagaccagacagaattcaaaatggatctccatgagttccagaccagcctggtctccatagcaagttctaggcctcatattgattaaggtaattagtgtcttattgatagatttattaataattcttctattgaatagttagggttatagttagatataatggcccaaatgataattatgataattctggaaatcttttgttttaggagggggaatcagtctccctctgtagtccaggctgtactgaaacttgggatcttcctacctcacctcttgagttctgggaggtgtgtgcctgtaaaggtatgtgcctaaaaaggtgtgtgccaccatccctggttggaaatactattgttaggttcattattagcataggataacaaaggcataaatacgaatataataggtctgctaaattttcccaagatgtgctcatcacaggcttcatgtccattctgtgtggcaaagctgagagtgtattagtttttctcatctcatttcaccagcatgttctttatcaggttatgaacaaggaagaaacagacaacttaatgttcgtctaatgtccaagttacatacggggttcagaaattcaagctacaacacaaaattaaggtacataacaggaaagggaggagagatggctcagtggtttagagcactggctgcttttccagttacatctgtctgtaactccagtttcagaggacccaatgcccttttctggcacgcggcacccatatgatacgcaaacatatatgcaggcaaaacatcatcggtacacataataaaatagaatgaagcaaaacaaaaagaggtatacaataccaccaggatgaactcaaatggtaagtggcaggatatagaatcaaggaatgccaaagccaaagtgactttttattttattttatttgcggccttgactggactttaaactggctgggcctttgcttacttacttgatttttcttttgacggtcctgttctgaataattattatttcctcatggataggacttaaaatctcttgtgtttggtaaaatacttgtgggcaagtcattattctacatttattagttctattattttgtttatttagtttctgaggtagcgtttttttttgttttgctcaggcctgtccctgcctgcctaggattagtgagtaagccacccccacaaaacttcatttgatacaggaagccctaccagtccagaagctaacccacttcgtcttttccactaactttatgcaactcaataagtaatttcaccagctgtttcagtgccagtgtaatgaactgttgcatagcaacacatagccttgccgcacaccctcctatcacaatcgctgcagtcatctgttctgcttttgtggtagtgctgtcccaggggagaggacatggtgatcttcctcattccacgatgaaaaaaacaatcatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggcggtggtgagttagtgcacatacaaccggaagccacctcggcaatgcagtctgtgagaaggcttggttggctaccgtgaccaggggtgatgcacttggttagtccctgggcagccaaagagacgttaacatgcttgttcaagaaacttgcttcacctagcctttgaggtagattgaagttgggggctaaagtaaaggttcaggtaaagaggtgctaatgtggcaaagtggtcgtactcccctcccccgcttgggtgatgaccatagaaattgttcagaaggagaaagtcagaagccttttgcttgcttggcagttcttctccgtgtgggaaattgaactaatggaaacgttcctatagtgtacattttgcctgcgagtagtctgtctttattggccattgctttcagcggccagttgatgcaagaacgctgaatgaagcaccattgtgttttgagttcatttttgtggaagaacattttaaaggaaggttttccagagatgataaaggttgctgctatgcacctttagtttacgtttatacttaactctcccccacccccaaatcttaagcgtcatctgtttcagtggtgcaactctcttcactctcttcatttcttttcggttaccagtcaccttcaggccattcagtggagggacaagtgggaaatatgaagtcagccaagccccatgtgacccacagtcagcacggggaatgcctgcaggccctgagccctctgcagtctactctcagttctgcttcatctccttcccaggcgtatgaaacgtatatcgataatggactcatatgccttaaacacaaaattagaaacatcgagaaaaagaaggtaactttttacccccaccaagccctgaatgtgcatgaccttaagccagggttaaggagctgacatattctttatcatcagagaacataggtcttccaaaagatttaactgaccttgagatttctttgcctgggaataattaagcatctaggctaaatgcttgcttcatttgccaacatagccgaataacaatattcttcacagtaaatttgttacacatactgcttttgaaaagtttgctgttttaggtctgattaatttcttgagatatattattgtttcttatcctagttccttgtgactgcatcaagtgatatggcagtacagcctctgcagtcattgggagcattttgtcatgagccaggaaatgctttaacatttttttccacagctagatactggtttaagattggttcaggaaagtgtggtagacagctttgtaaagagactttggatccttaccagtcctaacattacagtaaatggtatggtaaagatccagataatttctcatttcctcagtcagtccctagggatgcactgttgtgtcgtgtgtggttctcatttacttttgacaggtaaggctgaataagttctacattcttttaaaactgcagcacaagatctagtaaaacaagaggaaagttttttgtttgttttgtacagggatatgtagagatttttgatttttattgactgtatcttcccttgtgttgggaggtagcacagaagggctaatggtttttatcttttccatgcattttttttttttcccttcgagacagggtttctctgtgattttggaggctgtcctggaactagctcttgtaaaccaggctggtctcgaactcacagagatctgcctgcctctgcctccgagtgtgggattaaaggcatgcaccaccatgcttccatgcattttttgaatgcatgcatttagttactagtgtgactagatgattgtgcctgggtcagcacaggttccttaacgctgagaactagctcatgcagggtctgttagtggagagtctttagtgacattcctagtggacatgttgagtatgtgttttcctgtgttatccagctaaactgtaattacttctttaattctggatgtctgtttgctattgacagtgtctttgcttccagcttctaggtaagtattttaagacctaaaaccaatataggaggagcctgcaaaatgcttatgtcatgattatggggctaatagatgaaatttagtttttatgtattttcttaaataccaaaatttcctatgacaggtaacatcatatcttggtgcttctgttagaaagttaactattatgaaaatgctacacagttcaacaggtaacagtcagtagaataagtaagcatgaactacaaagtatgcagaactagtcagccatgatgctattgatgctttgtgctagatcagtgcttctcaaccttccttaatgctgtgaccctttaatacagttcctcatgcggtgatgaccctcaaccataaaattattttgttgctacttcgtaactgtcattttgctactgttatggattgtgataaataactgaaatgtgacccccaccccaaagaggttttgacccacaagttgagaaccactgtgctggataattccttgtgagaggctgccctgaacagtgtgggatatctgtcagcagtcttggcatctgcctaaaagatgccagaagcactgttaacctcctccagactctgcaaattgtgataatctcatatatctctgggaataaattggcctggctgagcacctctaggtaggggtatatggttgactttagaccctatttaagtagactgattataaatagaagccattaagaggttaaaaaaaataaaatcaggctgttgagatggcttagctggtaaagctgcttgctgtacaaacccgatgacctgagtaataaccccaggattttgcagtggaaggagatcatcagctcccaaaagtcctcagacctctatacatgcactaataattttaaaaagattcggggctggagagatggctaaaggttaagagtatgtacagaaagctgggcatggtggctcatgcctttaatccctatacttaggagcaaaggcaagcacatctctgagttcaaggccagccagggctatgtagaaagaccctgtctcaagaacaataacagcaaagagtacttacagttcttttagagaacctggacttgattcccagctcccacatcagacattttataaaccctccatttggtggtgctgatggtggaggagtactgtctagtgatgactctgacctcctggggcacctgcacttatttgcatataccctcgcacagatacacataattaaaataagtcgggcttggtggctcatgcctttaatgctaccactaatgaggcagaggcaggcagatctctgagttcaaggccagcctggtctacaaagcaagttccaggacagccagggctacacggagggatcctgtttcaaaaaattcaaaaaccacccccaccccagaaaaaaagaattcaatcactacactgatatactagttcatcttagcatgctgacagctctgtgtatcatggtagtttgccacatacttttctataaaaaatttcttcatcagtgctgatattttcatattctaattaggtaactccaatgtaatcctttaaataaccccttattataccacacacattaaaaaacccaagtacactgacctgctgcttttgtgcctcattttgggaaacttcaggttcaacaatgtgtttaaatacagtgagaagcttactttttaaaaaatttttttgagattgggtttctctgtgtagctctggatgtcttggaactcactttgtagaccaggctagccttgaaatagaagaagtcagcctctgccttctgagttcnnnnnnnnnnnnnnnnnnnnnnnnnnnnnnnnnnnnnnnnnnnnnnnnnnnnnnnnnnnnnnnnnnnnnnnnnnnnnnnnnnnaacagtgctaataaagttctttcctcaaaatgagccttaactgttgaatgattttttactgggataccagatttctaggaattccattttttacatagaaagttattcatgtgaggctctttgagttaatgcatggtgaaaactcaaccctctaacctgattttttagaaataaatttaaatagtatatatctaagttgaaagactagttcttatctcagaattgtgaatattaaatgaatggggaatgaagcatctgtcacactgccctgtcaccacaagcactactcccctgctttaactgccgtgcaggtttaccttctgatgcatgactattccatctctttagaggctttttcctggtttcaagagtagggagataattaagatagttgaaataccagcatcaatgcattccaactacagtggtttatacctgtagtgttcagctattcttagagcagcctcagctcttaagcttcagctgcatttttgagatgcagacaagttcttggagcataaggcaaaccctggttgggtagaagttatttttttccgttggtcaagtgcctgaaatagctactaaattgtagtaagtttagctgtaatctgctgggatgagtacgtgggacaaagctgactgatactgctctgtgtttttttttttttttttcccaactgagttggaacacaaataccgttgctatctgcctgtatgaaattgtagtctggcataccagcatatttcaagaatctcatttgcttcagatttttttctatcagattatgccataaaatacatatttctcttttgtagctcaaactggaagattataaagatcgcctaaaaaacggagagcagcttaacccagaccagttggtaagtagcttgagattatttgttagatatactggtctgctttcttttctttttttgtttattttttgaggcaacgtttctctgtgtagccctggctgccctgaaactcactgtgtagaccagactggctttgaacttacagagatctgccctgcccgtgcatactattagatgatattggctagatatgggttaaatagaacaagttagattagataaggtaccatgtacattgaacttaattcgtggtaggaagactgagtatactcaagttttcaactcttcactggtttaatataaacttgacatctttctattctaaaatctgtttttgtagctttgtcatgattctgacttgctctcttttaatttcttttatacttgagttatgtacttagccttttaaacattaacttcactataaatattgactataatttttcttattttgaactcatagtggtacttctgcattgccctatgaaattctggcattgcaggccacacaaggcaccatgcccagctacaatttttttttttcatgtttgccctgttcatgatatacctgttaattccaaatattactagtttgtgaaggagaacatttacaatatggactaaaaaattctttatggttatttgatgttttggcctgatcacatttcctgccttttaagaagggacaaagtgtgcctaaagttatttaagatttattttttaaaatgtatgtgtatgcatgtatatctttgtgtgggtatgtgcatgttagttcaagtgcatgtggaggccagaagaggtattggatcccctgaagatgtagttacaggcagttctgaactgctcaatgtgggtgataggaaccaaattcacatccttgggaagagcaagtgctttttaactgccaagcagcccctccagacctgaagttatttgatctggctcatgagcctgttaacatttccctccttgctgtgttgtcatcttctctgacctagaagtcctatggtgtagtaattatgattctattgaggcttagctttgaattatgtgagctctgagcaccctctacatagtgaagggacttggctaatcagccatcatttatttccttggttttgttttcatgctctgtccactaacttaaaatgtggaagcttctctgtaagaatcccagaagttctgttagaatcgtatcattgaggcgcttttgatgtgaacttggttaaagtgcttgctgcataagaatgagatcctgagttcagtcctggagtccatgtaaaaaagttgggtgttgtggggtgtggtgtgatgtggtggtgcactctttttaagatctatttatttatttatttatttatttatttatttatttatttattatgtgtacagcattctgcctgcatgtgtgcctgtaggccagaagagggcaccagatctcattacagatggttgtgagctaccctatggttgctgggaattgaactcaggacctctggaaagctgtcagtgctcttaatctctgagccatctctccagccccacactcttgtaatcataaccctggagtggtggagacagatccttggggcttgctgtctagtcaggctaacctatttggcaagttccaggcgagtgagagaacctatttcaaaaaacaaaataaaaaaagccccaaaaccaaaaaacaaagcaacaaaatgaaaacaaaccaaaaacagtggagaactgtagagattggtgcttaagaactcttattactcttctagagaacctgagttcagttctcaacactcatgtcactcagctcacaactgtctgtaactccagctccagggaatctgatacttttgcatccttggttaccagtatttatatgcacatgccaatacacacacacatatttatcattaaaaataaatgttaggggctggagggatggctcaacagttcagagcacttactgctttactagaagaccaggtttaatcacatggtggctcacaatcatctgtaaccagttccagggtatgtgatgccatcttctggcctcagtggccaccaggtacacaagtgttacacagacatacatataggcaaaacaccaatacacattaaattaaaataaaaaaaaaaatcccccaaaacaccaatgacctaggcttggtggcacatatccttaatcccagtgctgcggagacagaggcaggcagatctccgagttctctgaaagagcacacagggtttataactgccaagctatctcttcagtaccatgaataatctttttatgtatattgacatatacatttatgtagaaatgttttgttttgagtaatgttttctaggagtagaataatacactatctgtatatgtgtgtgtgtattttttaaatatatatttacttactttgtggatgtgtgaaggtcagagaacaacttatagtagtcctttcttttctctgtgtggattctaggaattgaacccaggttgtcagttatggcagcaatcatattcacccaccaagcaatctgttgatactactacactatctgaattattgagactccaatatagttttaactgcttgaataagttccctaacttgttctgtcccaagtggacctttttcttcattttaagttaaaaagggtctgggcatggtgacacaaaccattaatcctagaattcaagaggcagaggcatgtgtagatctctgagtttgaagccaccatggtctaaatagtgagttcctggagtgtcagatctttatagtaaaacaacaacaacaacaacaacaacaacaaaacaaagcagaacaaacaaaaaaagcaaaattacatttatttattggtatgagtgttgtggggaggtcagaggatagtttgtgggagttagttcttttcttccaccgtgtaattcctgtggatcaaagttggtagtcaggttttgcagcaagtgcctttacccactgagccatctcatcatctggctccaaactgacttttgtctttctccacaaaaagttaagacaaactcatctcttctgattaccagttgagtatgaaatcttttatttatttatttttagtcactttatgtgtatgaatacatatgtttgtgtcctgcatatgtttgtgtcctgcatgtgtgtgcttggtgcctgtagaggtagaaggaagtgatggatctcctagaaccggagttacagatggtgtgagtcatgacatggttactgtgaaccaaacccaggtcctttgcaagagcaacaattgccttttaccttaagccatttttccaggccctgtaatatgaaatccttgtttttgttttttgagacagggtttctttgtatagcctttgctgtgctggaactcactctgtagatcaggctgcctcaaactcatagagatctgcctgcttctgcctcctgggtgctgggaataaaggtgtctgccaccacagcctggcatggtatgaaatcttaaaagaagttacttctttaatttcagtaggatagtgcttgttataatacttatgatatctattacaagcaattatttacacattgtttctgccattttttagatgtttcacagttgctcttcttctgtgtgatatttattattcctatagtacgtttgagtggtgaatgatgttgactgaggaatcttaatggcttagtgttctcaaaacccatagagatctctaacttaaatgtttagataggatagaattaggactctgatttttttattttgttacatgtgtgtatgtgtatgtggggggccagatggcaacttgctgaagttggttttctcctaccatgtggatccttgggattgaattaagctcttcaggtttggcagcaagaacttttacccactgaaccatctcaatggcccagggctctgatttctaatataaaaattagaggtttagcttggtagtgtatctaaagatatgcttgagggattgaggcatgggaatcgtaagtttgtgtctagcctagaatacgtacgagttttatgccaacctgagatccagtgagaacctgtctttaaacaaacaaaagtagaggcaggtggatctctgtgagtttgagaccagcctggtctacaagagctagttccaggacagcctccaaagcctcagagaaaccctgtctcaaaaaaaaacccaaaaaataagtaaaaaataaaaaaaataaaataagcaaacaaaagttctagcattaaaatagactttttatattactttaccttgtagataccgtttctttcagtaagtacttttctaacttacaaagtcctatctcctttatcaattaaaaatgatttatgtttatttgtatgtgtctgtttgtgtatgggaatgtatatccaggtgtccagaagagggtgtcacatctgttagtgctggaattatggtgactgcctgatatggttgctgggaactctgatcctctggaagagcagcatgtactcttaacctctaggccatctctctagccctttagccatttagggaacacttatttattctgagcttaccacggatttgctggggtttttttcctgtctggtaggaagctgtggagaagtatgaagaagtactacataatttggaatttgccaaggagcttcagaaaaccttttctacactgagccaagatgtgagtatgttttcattgcttttctttgagccactttagctgctgacgttgaagaatatgccactacctaaaaattgtgtttgcttatcagtcatctgaaaccatgtggatagtatactgaggaagtctcactaagactcctaggaagtccttgaactcaatatgtagcccagacaagcctggaaattgtgattctcctgcctcagccacttgagtgtctgggattataggtgtgcacagttgtgcctggctctagactatttttaattttctgctaaatttatttaggcttggtattcttgactttgaagagatttttgtttgtttttttgagacagggtttctctgtaactttggatcctgtcctggaactcactctgcagattttgaactcacagagatctgcctgtctctgcctcctgagtgctgggactaaaggcgtgtgctatcactgccctgtgtgttctttttcttagggcactcatatatgttcttccaccatggtgctctagagatgtcacctactttggcaagctatgctgtgtagtttgactttccttttgggctgacagcccccaaacaatgacattgagacttaataattatgaaatcttgacctttagcttaggcttgttcccaactagttcttataacttaaattaatcagtttctgtcaaactatgttctatcatgtggctttttacctcttttccattcagtatgtctgactttctcagtttttcactggcatctcctgcacaccaaggttctaaccctctaagttcctttctctgcctggaagtcccaccaacctctcctgtctagctattggctggtcagatttttattaaaccaatcacatcgacacatcttcacacagtgtaaaaaaatatcccacaacaatgctgattccatgaaagcagtttctttttttggtgctttttttttaaaaaaataattttttaatggtcattggtgctttgcttgcatacatatctgtgtgagcacgtcagatgcccctggaactggagttgcagacagttgtgagctgccatgtggatgctgagaattgaaccaggatcctctggaagagcattcaatgctcttaaccgctgagccttctcttcagcccccatgaaagcattttcacttgttgcccatgctttatatcttttcctccctccctccctccttccctacctcacccttgagacaggttctcactatttagcactagctggtctggaactcactctatagaccaggctggcctagaactcagagatctgcctgcctctgctttcccaagtgctaggattaaaggtgttcattaccatgcctgggcactgcttcagatttctttctcctcataatgtgacagtaggtctagagcttgctacaaccccatctcatcccatttgaagtatttttagattaacttactttacatgtgtgttttgattgcatctatgtgtccatgtgcataccttgtgtttgaggaggttgtcagatagttacaaaccaccatatgggtgctggaaactaatagacctagggtcctctacaagaggtctattagctgagccatctctccagccctgagcttgtcttcttgagtcaagccttcaaggtgtttgtcattaccttcctattcctttttctcgtagtttttgggctgctttaaacttttgttgtcacgtcaatagattgtggaacatcttgttcttttatcctcagtctaactacattcttcttagtttcttgagatgatttctgttcttagccaaaatccattatactaagtaatggtttggaaaataaacttttgttcagtattgctgattggattgttcatgtgttttccttttcaaactgatcaacaaagaagaaaaaggtgtaagattttcttagtttctacataggtaaagacaagaaagctgttagtggttttcatgagatctgatcatgagctaggagacagtgtagttagttgacttgatttatttaacaggtatttgagttcttgttacatatcagtctctgtgccaggcagtgatgtatggatgaataaccaaaatatagtctctgtcattatgaatgcagaaaaataaaagtgacaactagggactggaggtgtagttcattaggtaaagcactagcttagcgtctgcatggccctaggtttgattcccagcactgccaaaaagcaataaatagataaatgaattatacacatgactatttgatgtgacaaagactttgctggaggactttcaggttggcataaacccatagaacatctaatctagttttgggaaataggctaaagagaaatatgaagtaatgaagtggtatgtatgtgtttatttctgtgtgttgtgtgtatgtattcatgtgtatatgtgcctgtgtgtggagacccaatattgactttggatttcttctttgattattctctactttattgagatagtgtctcacttgaatccagaggttgcctatcagctagtctagtagccagtttcatgagggatcccatcactgcctcctgagtgcttagtgttacaggcagcaccatgcctgcctggcttttaagtggatcctggggatctgaattctttttttttttttttggtttttccagacaggatttctctgtgtagctttggagcctatcctggcactcactcttgagtccaggctggcctcgaatcacagacatcttcctgcctctgcctcccgagtactgggattaaaggtgtgcgccaccaacgcctggcgggggatctgaattctaatcatcacactttcccttgggcaagccccttaatcactgaaccgtctccccagctctatgatgtgtatgtggttgtgaagacattttggttaattagagtgcaaagctaaccacactagccatagagtccaggcagtggtgacacacacctttattaccagcacttgggagacagaggcagacagatgtctgttagttcaaggccactctgggctacacgagattgaatctgtctaaaagagaaacagagctcacacaaaggtgatcccagcacttcgaatcccccgcctttaatcttagcactaaggagtggagacaggaagtgatacagctgggtggagaggaatataaggtgggagaagacaggagctcaatgcagtctgagtctgaggaacagtgcatctaagcagtctgaggatttgcttctctgatatttagcattaaccccaatatctgacttggcggttttttttttttttttttttttttttttttttttttttttttnnnnnnnnnntctctgtgtagtcctggaactcattttgtagaccagcctggccatgaactcactgagatcctcctgcctctgtctcccaagtgctgggattaaaggtgtgcaccaccaccacctgaccctgactctgagcttttattattaaaacctaagagaacttgtattacagaccacagcaactcttataaaggaaacatttaattgtggtggctcacagtttcagagattcatccattatcatcatgtcagggagtatgacaacatgcaggcagacgtggtgctggagttgacagtccttacattttgactcagaggcaacaagaagttgactgactgtcaccctgagggaggcttgagaaaaagatacctcacagtctgcccaacagtgacacacttcctccaacaaggccacgcttcctaatagtgccactccctttgggggtcattttctttcaaaacacaacacctttttaaaatttctttttgttttgcttcctttctttatacttttcccttattttcctcttccctttcctttgccttgctgtgtagatggcttatttggaactcatcttgcagttggctgtgctcaaatttgggaaatcctaggcatgcattactgtgcctggttagatatatcttttatagactttaagattgtatcaataacccatttattggaaaaaaatcttgagtctttttctttctttgctgttttgttaagaaataaccagtgttatagaaacataatcataaaagctatgtgggaaaactatattttcttagtggaaacaggtacattattatttttaaaaaattaggcttattttgttttatgtatttgagtgctttacttgcatgtatgtatgtgtaccatgtgtgtgcctggtgctcaactagttcacaagagggcatcaaatttcaaactggagtaacaggaagtaatgacccccatgtagagttgggactgaactgagccctctggaagaacaagcgctcttaaccactgaaccatctccccagcccacaattattatttttttttcagatagggttttacttgatagcccaggttttcctgtgttccctatggataccaggctggccttgaactcacaaacatctatcttcctatgcctcctgagttctgggattcaaggcatgtgtcactgtgcctagcaataagctctttatttaaatggtatgtcaccttgtttacataacatgttaagcttcaagataaagnnnnnnnnnnnnnnnnnnnnnnnnnnnnnnnnnnnatctctgagtttgaggccagcctggtctacagagtgagttctaggacagccagggctccacagagaaactctgtctcaaaaaaaggttaaaaaaaggttggtatgttgtgggtgggtgggtggatggggtgagctagagggaatgggtatgactaaggttcatgttatattatacattaatggaattttcaaaaaatagaaattgaagctgagcgttggtggtgcacacctttaatcccagcacttgggaggcagaggcaggcggatctctgtgagtttgaggccagcctggtctacagagcgagtgccaggataggctccaaagctacacagagaaaccctgtctcaaaacccccccccaaaaaaaaaaaaattgaaaacaagaaccctcattcctcattcaattaaaaactttaatgatggaagtgggggacacattttctgtgggtatttttaagaaaaggttgagttttttgttccagatccctgtggttagaaatgtttggtttttggaataattaattatacacataaaagggactatcttagggatgagacttaattctagatatgaaattcacttacatttaacatagcctaagggtaattttatatactacttttagtatgcttctatatttaattttatatttattttgcatgtgtatgttgtgtggtggtggtgtgtaaatgccacagcacacatgtgaagatcagagggccacttgtgcttctattatatggagtctaagattgaactcaggtagtggggcttggaagcaactgcctttaacctctgagccatctccttaactcagtgttactgcatgggtatcaagattcactggactcagtacaggttaagtgaagtttattcagagagattgtgcttacacaagaggctggtgaccatctcgggttccagctccaaggatcctcccaggctgttccctgtgactcaatcggaagtaagagagatctgggtgatctccagggccccagatctagtcagtcctctccaccatcttgtcctcacctgtgaccacacccatttggctataggtgtgggctgggtggatatctcactacacagtgtgcctacatttttgactgtgacccatcacatggagttagatgtggaattttctttacatttgtattttcacattggtactcaatttaagattttgactttttttttttgaatttttttcctttcttccttccttccttccttcctttctttctttctttctttttttttttcttttttttttggttatttgtagagcaggctggtctcaaactcacagtgatctgactatgcctcccaagtgcggcaaaagttgtgcaccaccacccccagcctctgttcagtttttcagttgcaaagtgtatcatctaggctgggtgttggttttgtgcgccttaaatcccagcacttgggaggcagaggcagggggatctttgtgagttggaggccagcctggtctacagagccagtgccaggacaggctccaaagccacagagaaaccttgtctcgaaaaaccaagaaaaaaaacttaccatctaatcccagctaacatgggtaattgagatatgtgaacctgcatttgttttaacagctactgaaagctcagaaaaaggcccagagaagggagcacatgctaaaacttgaggctgagaagaaaaaacttcgaactatacttcaagttcagtatgtattacagaatttgacacaagaacatgtacaaaaagacttaaaagggggcttgaatggtgcaatgtatttgccttccaaagaacttgactacctcattaaattctcaaaactgacctgccctgaaagaaatgaaaagctgaggtaagtcagtgaagtgattttcctgatatagaacttgtcgcacttttagcttttctgttataggtagttagggattaactaagaaaaatcttaattttattcaatatgggaaacttagatatgtttgatagatcattcaggaattcagaaaagtttgaatgttttcattaaccctgtctgtagtatagcgctgattttgaaaataatgtttggtcaggtgtggtgagaccgtctctcaagcaaaacaaaacagcttgatcattgtcttcaccctatgcagatattcactgtgatactagttataaatgaactgatgatttaaaactgtaaaattgaggctacctaatatttccttccccagttagctactattttttgtattggatatatcagctaacagacagatgtttatgctttttctttgttaaacatggattggtccagctctttgttagctgtgaaagcagagcttagaagagttcagctgttactaaagatcagcttggtgtagggaagaagctccatacaactcagcttactctggaagctgcatgccttactccttgctggtgttctgttcattgtctctatctgttgtttgttggttgctgccttcccactggagttggttcagggaatggggctttctcatgttgaaaagtaagccactctcaggctggagagatggctcaggggttaagagcactgcccgttcttccagaggtcctgagttcaattcccagcaaccacatggtggctcccaaccatctgtaatttagtctggtgccctcttctggactgcaggtatacatgcaggcagagcactgtatatataataaataagtaaatctttttttttttttaaagaaaaagtaagccactctctacaaagtaaagtcaaatggagctttgagtgtttccatttcacttttattcctgaggcacatttgataactaatgatactgcactggcagcttgaattcttggtctatcccttggtagttgcattggtaaaatcttttttattcattttaaggaagacatttagttttgataagtatgtagaaaattcagtattttgcttccaaataataaaagggtaaaattagcatatttacatatcttgactgttgatgggttatattttatatgtacattgtactgctcttcatgtgtatgcgtatgtctaaagccactctgttctgctgctgcttttccttgtcagtgttgaagaccagatggagcagtcatccttgtacttttggaaccttttggaaggtagtgagaaagcagtggtaggaacgacatgtgagttttccctactctggacttaggtagtaaatagtaaactttttgcctaaaggtttagtatgatattgagggtctaaactgtattggtccaccagaattgatatgtctgacaatggtgtattcattggaagaatggtccctttatttatgttaaaaggagctatcgtatattcctatttactgaaagggaactaacagatttcaagtgacaaccaatatgatttggaaacaaaagctaagtactagttctggtttaatactagcttaatcattttggagttcagtttcctattctgaatagtggtacatgttctagttgagaactttaaatccctaccttgttaatataaggcttatttagtaggtcattctaagaaatgacaaatggtttgcctagtctgttggacggtcagatgaccacattcaaattgccagacatgaaatataaagtacacagcttaggatcttgaaaactccctataaagtaataaatattttcataatagttaatttcttcctctttagaaaatatctgctgggtgttggtggtgcacacctttaatcccagcacttgggaggcagaggcagcagatctctttgagtttgaggccatcctggtgtacagagcgagtgtcaggataggctccaaagctacacagagaaaccctatcttgaaaaaaacaaaaacaaaaaagaaaaacgtaaagaaaatatccaagtctagggcctggggtatggcttagtaaagtgctatgtaatcatgaaacctgagttttatccccttacctgtgttaaaaaaaaacaaaacaacaacaacaacaacaaacatttcagcatgcaatggctgaaatcccatcactgaggagatgaagaaaggagaatccctggggcttgttgctggctagtctagctgaatcagcaaactccagattgaaggagggagggagggaagaagagagagagggagagagagagagagagagagagagagagagagagagagagagagaaagaaaatgcttgaagaagactcctaatactgaccaatagcctccctaggcatgtgcacgtgcaaccacacacaagtacatataccttcagaaaagtaagcccatttatgtgtaactatcaaggtttataactctgtttaagacttaaattataagtgaaaatttatatttttgatccaggcatggtagaatgtactctggtcccagttagtcagaaggtagtttgagcacaagaattcaaggccagcctgaacatcgtggcaaaccctgtcttgaagaaaacaaaaaagacaaaggaaaaaatggtttggaaaagagtttggcacttcctcttttattttatatacttactatactatatatactaagtatactatatatacttaccatatagccaaatagttacatgtccagaaccgaacagaaatgaaaacaagttctcacttaagtacaatgcttatactctgttcatagtagttctctgttagagtcagtgtaaatgcacagcagtaaattgatatacaaaataggatattttcattgagtagatttttagcaattaagtaacctctgggtctggtgtctcatgcctgtaatttttttcttaggagacacacacaggaggatcattaccagtttgaggtcggactgatctacacagttctaagccagctagagctacatagtgagagcttattacagaacaaacaaaaaccaaaatcccaaaacaaacagcaaaaacaacaaaaaacattaatacatgcaagagcatagatgaatctcaaagtaattatacttagtaaaagaagccagacaagacatgaatatatatattgtatgacttcatttatatagaattctagaaaaggtcactaagttgctagggaaggggaccaattcagaaggtccttgagggatttggtggatgctaaaaatgctttaaaattgtggttctgttggtggtagcgtgtttttgtagctgttaaagctatgaatgtgaagtaggtgaaaaattttgtttataagtaataactcaaagatgactaaaatatagctgtggtggtacatacctgtagtcctagaattcaggaggctgaggcaggagaattgctatgagtttgaggctagcttgggctacaaagtaagatgtttaaaacaaaacaaaacaaaaaaccaaggctgattaaaaagagaatcaggccaggtgatggtgaagcatacatttaatctcagccctcaggagggctcagatctctgagtttgtggccaacctggtctacagagtaagttccaggacagccaggaccacagagaaaccctgtctagaaaaacaaaaacaaaaacaaaaaaacaaaaaagagagaacaaatcaatgttataatacgcaatgaataataggcacatactatggatgttctgcctggtttggaattgggttttattggacatgtaaaataaaatatatgcaactttgacattacttttataattaaaaaaaactttctagtgctagtttgttagaagtgacatgagtgaaatcttactgaaggagttttacaatttaaaaatattaagccagttcttgtggctcaagcctgtaatcccagcccctaggagatgtgggatggctaaggcaggagaataaccagtttttagactgcctgggctaatagttattgagacttggtttccacatagccaaccaaaaagaacaaggacaacaaaaccaggagtgtctgagataagatttcctattggatatgatggatgaattaccttttatttctatatatccttaactaataggtcaacatagagcagtggctagttgaatatcttggaagcatatggaaaaaatgtctcagctcagggaatttgtgccttgtcatactctttgattaggttctttctttgatttttagtcatttttcaaatggtaaaaatagagaacccgagaaactcaagtaatttgttaaatatatagtctcatgtttactgtttgtatttgctcaacatgaagtgtaaagataaatcactcttttattttcctggcacagacaattccaagtgtcctcctgcccccatccactcttgtgatggttaactataagcaggataacattgagattcttattctccataattgtcaatgaactcttaggttgtatgctaagtcttcatcactctttcttagacaaacatgtgaaagatctgctgtctaagctgctcaactcaggttattttgaaaatgtctcagttctcaaaaattctaaggaaaaagaggaagaaatgctaatgcaatcaggaaagaagaaacaattactgaagactgaatctatcaaagagtcaggtttgttgcgatctttgaaggttttttgttttgttttgttttgttttgttttgttttgtttgagacagggtttctctgtgtagctttggagcctgtcctggatctcattctattggccaggttgaccttgaactcacagagatccgcctgcttctgcctccctagtgctgggattaaaggcatgcaccaccagcgcctggccatctttgaagttctttagtttgctatttttttaactttatttttaatatttattttatttatttattttgaggcagggcataaactatgtagccgggttggctggacttactatgtgtagtaggctggtcttgaacttggatgattgtccttcttctgccttctgagtgctgaaattaataggtttgtactaggactcctgttttgttttgtttttaaaaatttgcttagcatacaaagaaatgggttatactatgacattttcattttcaaacatacaatgcttttgttcctaataattcttgcatgttgatgaaagtcccaccttgcccactttagcccaaaataaatgcacagagacaatatattaattataaactgttgcctggtggcttcttattggctagctgtgtcttaattattaacccatttctattaatctgtgtatttccacatggtcttggcttacaggagagcacctggcacagcctcttttcctgggctctacagtcttcctatgtttcccagaattctccttgtctcctagtcccgcctatcttcctgccttattgccaacactgttttattcatcaaccaataagagaaacatatatacagaaggatttccccatcacttgcattctctgatggtagtgcccttatcctttcatgacatgtattccattatagaggttgcgttcttaatgcattttagaaccatcattttgaaatgatttagtttgttggattctatatgaatggagatttttatttgttgtaatttaagcctaggtttagaaaacagattactagggattggagggattgctcagtggttgagtatgtactgctcctacagaagattcaagtttgattaccagcagcccaattggagagcttacaacttttttggcctctttgggaattgcattttgtgtatagacccacccttagacacaagtatacacaaaaattaaaaaaaaaatgttaaaaaagagagaaaacagtgttgtgacttacagtttagcttttttttttttttttaaaaagattttattatgtatacagcattctgcttccatgtatatctgcacaccagaagagggcaccatgtggttgctgggaattgaattcaggacccctggaagaacagccagtattcttaacctctgagccatgtctccagccccagtttagcttctttttgtttggttgagacaagattttctgtagtaagggctggcctgggttcttgttctatgtcttccaagtgctgagattaaaggcttgtgccactaaactgagttcaagattgaaccttaatagaaacattagtttacattttgttttgagagaaaatatttggttaaaactaggcatttgtgaaacctgaataaacctctttgctaaactataataggataattccatttatagtatagcttaaatttaagccatagtggaaaacagtattttgtagaaaaatgtgagtttgggatcagttattgatgtaagggaaaagaaaaaaaaaatagaaaatgagggattggggatttagctcagtagtagagctgggctggtgttgagggactttaatccaagcactttgtaggcagatgcaggctcatctctgagatcgaggccaccctggtccacaaaacaaatttcaggacagccagggctatacagagaaactgtgtctcaaaacaaacaaacaagggggaaggggagggagagggagaagggattggcacctgaagcaagcttgttcctaatttgaactaataaaataaaataaaaaaacaagaagaaaatgaaatatatttttgattagccatttatttccttctttccctttttaaaattaaaaaaatgtttttatttgtcagggtctcatgtagcccacgctggccttaaatttactatgtaatttaggatgaccttgaacctttgatcctcatgcctctacctctccagttctaagattaaaagtttgtactcctctgactagtttatgttgtattcagaatcgtatctaggaactatgctaggcaaagacaaccagctaagctacatccctggtcttacttcaccttaatactaagttcagtgcttctgtgtctccctctcttacctctcctgaccatagtatggtttggcagaggctctgtttcaagttgagtttactgatttgtccttgtaaactttaactgtaattgcagttttaataaggctatttgtaggtattttacttaggaataaaatcttaaaaccaggttgtgttggtacacacctttaattctagcactcaggaggcaggggcaggcagatctcttgagagtttgaggccagcctggactacaaagtaatttcctggacagccagggttatacagagaaaccctgcctcaaataaaccaaaaagaaacttcagtaaatatctcatgaaataccagcttcaatgacaattttccttaggacccattctctttttgtcctttcctttttgtgctggggatcaaacctcaggccctgtgcatgctgtgcaagtgcgttctaccactgagctacaaaccctaggccttccacgtgctcctgaccaataaacaatagctggagtagtcctgctatgaatatatttaattgcattaattattctgagccctttgacattctttactggaatgaattatggctatagccagactaaaaacctagaatttgtacttatttataattcttttatcttctcagaatctcctgtggaactcgtgcagcctgagatacaaccacaggaggtgagaatgtgatcaatcaggtcctttgctgaagttgttttaagttttcatttgttactgtggattagagtctgaggcttgggcagacaaactgaacttgaatgctgccttgcaacttattggtttagtgtctggctggattgttgttctcatctaggtagtgaagcctgggatcatatctggtgtgactgagggccaaatgggctagtctgatgcatagtaacttctttagaattacttattgctgttttaaacccttatgtttgactttaaggatgtatagaattttgttaccaggtttacaatggtagcagaagagagtgtttactctttttaagtgacattgaaatttgtggaagctgaaaagaatcggagaaacagatgcacaatacaatagatatgtggaggaaattgagaaaaacctgggaaccgaggagacatacagctaaacaatataactttctgtaattgaactatcctagcagtgacttttaaaggagggtgacaggtgtgtggaaagaccctcagtctggcaaagacaaaattgctttggcaaagggactatttaaagtgattgtagtgccataatatgtagtttcttctaatcttatatgggtcacagatttctacctttgaagtgtcaaagtttacatttctgttaattgaggagaaagagtagatacagaagtcatccagtttcttcaaataggataaggataagagtttcattcagagctgggtgttggtggtgcacgcctttaatcccagcacttgggaggcaaaggcaggtggatttctgtgagttcaaggccagcctggtctacagatccagtgccaggataggcttcgaagctacacagagaaactctgtcttggtggggaggctttcatgtcaggtagtttcttgtgagattgacagaaataggaatactaatagagttgaacattccattgaaagtctatgcattttaagcttgaagcacattgtttatttctctggcttagtttcttaacagacgctatatgacagaagtaaattattcaagaaaacaagaaagtgaggaacgatcttgggaagcagattatgtgagaaaaccaaatctcctcaaatgctggaatatgcttcctgaaccagatggtcaacagaagaagcagaagtcctccaagtcttgggagtcttctgtcaggtcccaggaggtaccaaagcctgtggtttccttagatcaggggaatcctaggtcaacattgtaggaaaagcagaggcagcagagttctatgacacctgtcagccaatggaagccacaaacccctaagtccaaagtgggcagccctcaagaagagctgagcatacaggagacaccaaagccatgggtagttaagccacagaaagaacaagatccacagaagctacctcctggatcctggacagtctctgtgcaaggtgaacagagggacaggagctcctggaccactcctatgtgcagagaacaggattcaatgaagcctgggactccagtgtcctgggaaaacaatgctgagaaccagaaacactccttagcaccacgtcacagattttttttaaagtcctggggagcagcttcagcaggcctgttaccaaatgaccagctcctgcccaggaagttaaatgtagattccaaagatgtgagtagatttctaagtctgcctcatcctgttgctgataaataaatctttctctcaggatgtgaggtttgtaaggaatgatccttggataatctcggctagtattgcttgttcttaaattataaattacttcatattgcttatgaaagcaaacatgtcaccactttgtttgctaacgagttaacttccaaggctctccaccccaactaagtagttgtcctttaaccacctgcttttttagccaggagctttctgatcaaatctttggagaggtcaaaacattgcattttataaataaacaaactacctctcaatgctgccttccagaaagagaattttagagttattcatcttttttttttttcttttctttcttgcaacagggtttctctgtgtaacagccttggctgttctggaacttgctttgtagacctggctggcctggaacttacagagatccacctgcctccagagcactgggatcaaaggtgtgcaccaccacacctgaattatttttgagacaagatcttattatgcagctctggtgggcttggaactcattatgtagactagtctggctttaaaacttttagaagtccacctgcttctgcctcctaagtgctggcattggaggcacgggcctggctttttcctttttcttttccttgtttttctctcttcacgagctaatattttttttttctcttcttttctcttcaagtgctgatatttttatcttattcctgcccttgtagaagattgacagctgcacttcattaatttacaacatctagtagtaattgtatggttgctgtttttgatatgcatattaaaccccattttaatatcccaataaagcagtaagagacaacagaactttaatttgagaatttgaggccaacctgatctacacatagtaagttccatgccagttagtgctacatagagagcctgtcttaaaacaaacaaacagaaaaccaaaaaaacccacaaattccccgtagggtccgaatcactaggtatttgaacctttaccatactagaatattgatcttatgctatttgttgaatgatattgaaaaacagggatgtttagttacaaaggtccaaacattgaatttgcttttatgggcaccattatgttgaagttttaggctctttcagtaagtaagagggcacttacatctctatgaatagctgatctcagctataaaaatatggcttaaggcaggagagatggttcagtggttaagagcactcactggctgttcttttcagaggagactgtggtttgattcctagctcccttatggcaattataacacctgtaattccagttctgcctatctgaatccttctagctctgcaggtaccaagcacatacatggtattcacgcaggcacgcactcgaacagagataaaacaaccatacacataaagattaaaaagaagaagaaaagaagcaagaactgtaaatgttagagcaaattcaagatgtctaccaattaatttatcatgagagcttctaaacagcagcagcttccaagagtatacttttaaattaaatataattgtgtgtatattgcatatggatatatattatttataaatattttaatgactctgaaatcacatgtatctttaaaatgggatgcatatttaatgtagtgatagtaatttttgccttgaatagaaacactgctatgtgtcatagtcagtggcttcttgtcacagagaacaaatagtagtaactgtataatggaacacttttatttttattgttattattttttccagtttttcgagacagggtttctctgtgaaatagtcctggctgtcctggcactcactctgtagaccaagcttgcttccaactcgagatccttctgcctctgactcccaagtgcctggaattaaaggcatgggccaccactgcctggcaatgaatcacttttaaagaatggttcttaattctgggtccttttagaaagaaatgcttcatatttttaaaagattttctttaaagttgttttgaaaggggaaagccaattaattggaaaatggatttatgtaaaaatcttactgtgataagtctaaaaaatagtatttccattgatttctgaggatgtaatcgtaatgtaagctgtgtgactgagactcacttacacatggcgggtttgtcttgtaggtgtgtgtatccatgcttcagcctatggactcttcctccccctttccaaaggatcctctattgaggaaagaaaaactgcaggacctcatgacccagattcaaggaacttgtaactttatgcaagtatgagctgttttgttttattttgatcttaggatattttttattctttgacaacttcttacatgtatagtgtatcttgatcatgtccagttcaaattcccccttcccattgtcttttatagcccccaatacttcccagttccaccttcatattctcatgaatatgagaatatgaaacaaaccacagcatttcgttagtgctgccagtatgtgtatgagtgtgggaccatttacccatttatcagagaaaaagcaatctagcagccacaagaaaaatgatgagctcccatcacctccagcagctatcaattgttgttagctcttcagctagatgtaagcctcataaatcccttatctcatcctccctgggatattgactagcttggatttctgtaggtcgccatagcttccatgagttcaggaacacaagagctttggcatgtccagaagagtgtttcacggtactcctcccaatcttctgtgcttgcctgtgggataatccttgagctttgaaggagttgatgcgtgtgtcccacttagagctgagtgagcatttaacagtcattctaaacactttggccagttatgagtctctgcactgacttatgcccatggcaaaaggcttctctctgaccaaggtttaaaatagtactaagctgggcagtggtggtacacacctgtaatctcagcacttgataggtggatctcagtgagtttgaggccagtctgatctgcagactgagttccaggacagccagagctgttacacagagaagtctcaaaaacaaaacaaaaaaagcataatgtatttaggagtcagggctgctgtgggccattggtaattaccctaagactgacagtctgtttgctacttggtctttcaggtcccactaaaaaattatgagacactcatcatctgccttcaaagctgtagaagattggaaacttgtgttaaatcaatagttaaatgataaattgtgtaaaagacttttttcactttaaaatagggtctgactgtgtagtcttgctagcctggtactcacagtgtagatcagactggcattgaattcatagagatcagcttgcttctgcctcccaggtgctgggattaaaggcctatgccaccaatccatcatgaaagactatgtttaattaaatagtgtgacatagactcttagagaatatcagagcagcagtatattattgaggcctgactactcaagtaaacaaagtaaatgtaaataaaggatctttgagctttggatttaaacacctgggtgtaaacaccaatcctatttcttgcctcataactccagtcagtttctttaatttccagccctagtctgcaaagtgagagataatttgaagataaatgaaagagctaggatgcttcccacaaattttctagctctgggaggttttcttgagagaaccctgatacacagatatgagaagagaatgtttatcagtatgaaccagtaggtgattgagataaaaataaataggccttctcattagttaggtataataaaatccaatttcaaacagactaaggccaacattttatgcttaagactcatatcaggagtgcatgtctaagttgggctttagaatcatgttctagtttaatacttgacccaatgttgaggtttgacagtaaccttggggtttagttttgactctttaatttcttgtttaagaataatttgttaacatcacaaggaagagccaggaaatggtggcacatacttctaatccccaaactctggaggcagatgcaggtggatctctgtgagtttgagtccaacatggtctacagagagagttccaggacagctagggctgttacacagagaaaccctgtctcaaaaaaccaaaacaaacaaaaaaccaaaaccacaaggtaggaattagctagatgtctgcacctttagtaaaagttgtgatcaatacagttagctacttaatcactttaaatgaatcatctgtgtttcttctcactatttaaaatcttatctttaggaatctgttctagattttgacaaaccctcaagtgcaattccatcgtcacagtcgccttcagcttctccaggtaacccagtaggagaataataattctaaagacttaaaacacacagctttatagttaacaactatttcttttacgaatcattcactccatatagcttaagtgtttattaatttattctaattatatccatcagtcagtagagttgcatagggacaaattatcattaggacataagtatactttggtaacatgtttatatttgttagagaaaaatcctcagatgggcaagtagaaatgcttaatagctgctttatcaattttccatgttctttctggagtgatttctgactagaacctgcttgacctttgaactgtaaatctagtgtggaggcttttgagtactgatatttagaacagtgaataccatggtaactgatgatggaaccttaatctaaaactggtgtgatgcctcaaagctgaggcctctggctccctgctaatttctctcaggtaaggaatgacatgatcaagctatagtccaaccgtgataagcattgaacacctgctaaagacttatgctgtagtgctgggcgaagcaaacgagtagtgactggttaatgagagaaaccaaactaaaagctatgtaattgtagaaagtatattattatgtgtaaccacaggggaaaaaatctaaacaaacagatgaccagctaagacttactattaagattatgtgtatcagttagtgacaactcatatggcttagtctttgtcttccagattattatccccagtaatttttttaaagtcatagttcttttattttggaagctttaatgcttttgcccatataaccttaaaacatcagcatgggggctgaagaggtggctcagtggttaagaacatgtattgtccttgcagaagaccagagttcaattcccagcacccacatcaggcagcttacaactgctagtaactccagctccaggggatggtcctaacatcaggtacatgtccatatacagacatacacacatgtgtgtgtaaataaataataataaaaatgttaaagacaaaaacaagaacaaaaaactgcgttaccatataccacagatggaattagtgtttctaactagtatccaatctactctcttcaaggttgcagtaggaacctgttcttccagctgatactttgtgaagagtaaactttgtcttgtcaagttgacatgcattactccccttaattgtttgatttattttagtttctacagtatctgcagaacaaaacttgcccaatcaaaatgattttcttcaagagccattacaagtaacttctagattaatttgtcttatactcttctttgcttcaagggggaagacttcttactttgtcaagaataatcataaagttttttcgtgcgtgcgtgcgtgctactattattggagacaaagtctcttaatatagcccaggctggccttgaactcactctgtagcatatactggtttagaacttgtgatcctcttgccttaggagtgctggaatgttgtcctgtgctagcattcttgtagcatttatgcttttaataacctctctatgtgagtctgcatacctacacttagaacccctagtctcaaacaccatgtttactcaccagtatgtaaagttacttctggctactcaaagtgataatttagaggcaagagtgattgcaccttataaatgaatactaatagtaaagattttgttgttaagtaaaacttcatttgcccagtgtggtgctagacattgaatgaatctagctaggcaaatgctctgccactgagctacatctgcaaccccatcaaatgaagctttaaataaaatttgacattttgtttgttattttgagccagggtttgctttgtagtctagtgtggtcttgtgatcttcctgtttcattcttctaaccctgggtaataggtgcattccatggtactgggtttcaacgtatgtttagtttaactattgaatggacaaaggaagattagtttagtatctgggtttttttcccccttgtacataagtatagctcaacagaagccagtctcatttatgatgggttgacttattattttaattcaaagtactgaaaaaagcatagtttcagaacaagctcataaacctaatatttttgttagatctaaataatgtgtgtttagtatataaaatgttctaaagtattacaaaaaattttccctaaactctctttggaggtggtggtggaagacaggatctgtctgtgtagccctggttggcctatcaaactctttctctttctgatgtgaaagtgaaagtgtgtgtgtgtgtgtgtgtgtgtgtgtgtgtgtctgtctgtctgtctgtctgtctgtatgcatgtgcacatacctgtgtctgttttttttttttgtttttttttgaaacaaagtcttatgcaacagtattcaggtggacttggagttcactatgtagttgaagaggatgaccttgaactcttgatcctcctgactctaccacctagtgcttggagcaggttatagaaacataactactctgatgttcagttaacatgcattgatttctgtgatgcacctgtgatgttatgcacctatgatgttactggagcttctaagaaccacgaggaagtattgggatgcagcattggatgcgcaagcacttagctaccactcctgctagattgtttttcgtaggcttctcttggattctaatacctttttgtatcataggtttcctaccaaactgctcttggtgttttattgttaagttgtcacggccttcattccttttgtgcttgtttctagtttttattatttatttattgggttttttgagacagggtttctctgtggctatcctggaactagctcttgtagaccaggctagtcttgaactcacagagagctacctgcctctagctcccgagttgggattgaaggcgtgcgccaccactgcctggcttctagtttttattttatacctgcttctaactcataattttcctagaactttgatactgctttgatcttcgtggagcttgtccatcgttttttatacttctgcctgcctctgtagggcatgaaaagtctttagactggaagcatgattagccctgtacctagcttgtcagcatgcactgtgaagtgtcagccacattgcagatctgacaccagattttcatggtcagcaaggctgtagtgtaactgggacacagtcctggaaaggcagtgtgtaaatctaagtgttctgctattgaactttattctaattttgggcagattagtttacttttctttgttgcctttcttttggttgttgttgttttcaaaatagggtttctttgtgtagctctggctgacctggaactcattctgtagaccaggctggcctctaactaagattcagagatcagtctgctgcctcctgagtgctgggattataggcatgcatcaccactgcccaactatttgcttcttgatgccactaaaataaggataatagtgcttactacacggatttgctagaattaagtgaattaataaatgtaatgcacttaacatactgcctggtaccactgagtgctagtaaaagtgacatatcagggagtccagcacccaggaaatttgaagtgaacacagaatgtgttgacaatgctttctgtctttctgtgtctaggtgacatcctcagttacttgtagctcaaatgcttgcttggttactactgatcaggcttcttcggaaactgaaacagaacttatgacctcagagacctctgaggtaatgagaccttaattactttgctgtctcaaagaatggcagaatgagcttatgaattactggcatgattggaattatgatgtttgtatttgttaatgcattattttctgtagatgtgtgatcccagaacatacacaggtcactattttagctttgccatgtatgtagatttaatagtgcttatcttacctgatgtagtaaatgtatttttagaattatcatttttaagttttttaaagatttattaattttttatgcatgtatatatgtgcaccacatggtgcttggtacccgaagaaggcggaaaaggacattagatccctgtaactggagttaaagatggttgtgaactactgtgtaggtgctaggaattgaaccaaggttctctgcaagaacaacagtgtctcttaactgataagccctctctccagcctccctattactttttttttttttttttttttttttttttttttttttttttttnnnnnnnnnnnnnnnnnnnnnnnnnnnnnnnnnnnnnnnnnnnnnnnnnnnnnnnnnnnnnnnnnccccctgcctctgcctcccaagggctgggattaaaggcatgcaccaccaatgcccagcctattacttttttttttttaattttatttattactttttttaaaaaattttatttatttattatgtatacagtgttctgcctgcatatgtgcaggcaggccagaagagggcaccagatttcataacggatggttatgagccaccctgtggttgctgggaattgaactcaggtcctctggaagagcagtcactgctcttaacctctgaaccatctctccagccccctattttttgttttgatctcctgtagctcaggctgatcttgaattcctgatccatttcaagtgttgggattacaggaaagtatcactcagcttagttactactttattaattaattttaataagtagcatccagggctgcagagatggttggtttagtgattaagaacatgtactgagggacgggctggagagatggctcagcggttaagaacactggctgcccttccacaggacccaggttcaattcttgtacccacatggcagctcacagctgtctgtagctctagttccagggtatctgacaccttcaccccaatgcacataaaataaagttaaattattaaaaaaaaaaaaagaacatgtactgattttggaaagaatctgcatcttgattccctgcactcacatcaggaagctcactactacccgtgactgtagccacagagaatctgaggcatttggcttccatggacacttatactcacatgcacaaaaatagatatattcacacacatacatacttaaaaacaaagtagatctttaaaataacaaagaattaagtttcttattgaaattttaatttaaaaaagagaaaagcaaaaacagagagagagagagagagagaaagagaagctttaggtaggattaggattagggaaaatatattcatttaactgaagatttgtttttttatagtgttattagcactgagttggaatgagttacagtctctctgactcatcttatcaaaagcattttaacaagccagaagtggtgacaacccccgcccccatttaatcccagcactcaggaggcagttgggtctctgagtttgagaccagcctggtctaggaagggagttgaaggctgtcaagggttacagagagaaactccaagaacaaacaaacaaaaaatgcagaatcttgacagtatgaggtttgtgtgtgtagttctaaatttcagctttgctgtttgagcaaatccttgagctagatagacacagatgggataaattttggggaaattcagtaactgttaggttagagttttgaggtgaactaataaaggagaattcattatagactataagaaagcatagatagttagttgttatagtactcatttggtctaaattaagatagataacttctttatgacacgaaaaaaagtgacttttactaagtgacctgtagtgatctcctttataatcttgtagggattgggttttatgtcatactaatttggctttataggtaaagattacttaaattatatgagttgtgttttttttttttgtttttttttttgttttttttggcagaggacttaggaattcattaatcttttaaatagagaactaacactaaggaactccccaagtttttcttaaactcagtctttgcttatattcagagtaatattagattattagttggaaaatagcaattcagagcttgtagggagcttggtggtggaggaagttgtgagccccttgtgtgatacacactttgtcagcaccctatcaaaaagcaaatgctagtgtgcatcctcagcagacgagatttaaaaattgtaagcaaacgctgctctctgcattcctgtgttcccatgtcatcctaaagaacttgctgacttgtgccagcttggggcttagtgtaaattaacctcctgtcatatgtatggcaagtgtggctgatgctgcatttctcctccacagatggccgtttccacaagtaagccagcatctgcacttacttctccaaatccccccttgtcaaagggcttccagttacctcctgcaagtggaatctcagcatccattagcacagcaccctttcaagccttgcagacagtgagtatgtaagggctactgaatagccgtggtctctcccacactcatctttggcattggatgaaaattttgccttcatgttgctcttatttgggttgctggtgtttacatttgtccactggaaaaaatgatgttgtgacagagtattatatctacaacctccagaattttcaagaagtatttttttttcttttattgaaaatagacgggctggagaggtggttcagtggttaagagtattcactgctcttccaaaggtcctgagttcacttccagcatccacatggcagctcacaactgtctgacgccttcttctggtatgcagatgtacatgttagacaaagtatctatatacatcaaataaataataaaataaagaaaataggcttttttcatacaatatattttgattatagtttccctttcttttcttttccctgttcctctccagctcccctcctatccatatcccctcctatctttagaaaacaaacttgcatctaagaaataataataaagtaaaattaaataccataaaaaatcagaatatgaaaaaaatcaaacaagaaaaagaaccaaagaaaaagcacaagaatcacatatatatagatgcagcaacacacatgtttgaacacacaggaatcccataaaatccccaaaactggaagccatagtatatgttcaaaggacctgtaaggtagaaaaaaggttttaacatgagacagagaacctccaaggatgctgttgagtttgttttatgttggccatctactgctgggcatggggcctacccttaagatttgttcaaggagattttttttatcagagccttgtttcctctctgaaaattaatagacaaagcttaggacccatgtaagaatgtgtgtggttgatcccctgtactccctcctcacaaaaggaatatgtgggtggtaaacattgttttgataacagctaatgttaatcgtcaccagttctgtattactgagggtcctagcatcagtaacctgaaacaaaaggatacatatatatgttagttctcttattcctgaaacattcttttaattttattttagtctcattttgttttatagaagttttggtttgttcaggtgtgagtgtgtgtgtgtgtgtgtgtgtgtgtgttggtgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagatttgtataatttttcagggggagaaaacctttcaatatagcagtacatgcctttcctgttggtgtttcatctgggaccttggggatagtggtagtgggtgagcagtatagagcaggcccagaccagggctgctgaactcagtagcatgtatttatggaccctcctattccggctgcacagtttgagggtctttttcttgcttttcttctttccttggcagcctcataatattgtcgcacaaatttagtttttcttttcccaattaaaagcagacagtggttcatcacatgatgaaatagaatcctttacctgaactgttgaagtcctgcctaacctgtcagactactctactgggcttgtcttgtgttgttttgtcagagtccctctttgttgatggttttcttcatctgttctgcctctttgaagcctgcctagttcaagcaggttctcattcattttatttagcaggaggtaaggccctatctatttttaaagatttatttttgctatttttaattatgtgtatgtgtctgtgtatgggtatgtacataggagtgcaggtgccttcagaggccacaggcattagatcatcctgtactgtagccttctctacaagagcagtagcatctcctaaaagctgagtcttctctcaagctcttttaaaagcacatatcaggttttttgttttttgttttgttttagagacaggtctcactctgtgatctggatgttctggaactcactatgtagactaggctgaccttgaactcacagagattcagctagcactgttttttgtttttttttgtttttttattagttcaaattaggaacaagcttgcttcacatgtcaatcccttctccctctccctccccgtaggcactgttttttgtttgttttgagacgggtttttatttttgttttggagataagttctcactatgtaatgctagctagcctggaacttgctatgtagaccagactgtccttgaattcaaaactatatgcctgcctctgcctcttaaatgctgtgattgaaggtatactctatcatgctagctcaggaattctttttattcaccagaggtacagaaatgaagaacaaaacaaaccactaaagctattctggaagctggtcttttaccatggaagggagagaattagagagatgagagacagttactcaatactcaagtgtactgcacacaaaaatcgtcagagtagggaaggcaaagggagacacgtgttagctcatgacttgtgcttaggtgtctggaagactcctgcatggtggaaatttaacaactgctttcttcttgctggagattgaaccaagggtcttgcatatacactaggcaggagttctgcctttgaagtttttaaagtcttttaaaaatttattcttgggctggagagatggctcagaggttaagagcactaattgctcttccccgaggtcctgagttcaattcccagcaaccacatggtggctcacaaccatctgttatgagatctggtgccctcttctgatgtgcagatatacatggaagcagaatgttgtatacataataaataaataaaatctttaaaaaattattctttgaaaaacttatacatttatatgatctgttctgatcatatctatctaccattacttcatagccatttactactactccacccccagcttcctctaagacccccatctttgtctatctcctttctaatgtcatggctattgtcagtaataaccctgagtccacttaatgttacctgtatgtgcatggatgtgagaccattcattgggaagcgagtcatgtactaggggtcacatccccaaagaatggtgactgccccttcctccgcagtcattgactaccgtagttccctctatcgagggtgtctggggacccttccttcatccatgctgaaattaagactgggttgaactcgtgtaggttttatgaaggtgaccatacctactgtgagttgaagtgtgcaaccaccatgttatgttcaaaagtcatcatttctcagctcctgttctcatctaccagctctcaaattctgtctaccccatcttccaccatgttctctgtgccttggatgaggtgtggttgttaaaaatgatttatctacatctaagtgctcacttatactcagctagtgtctgcattgaccatcacccactgcaaaaagaagcttctctgatcagagttcaaagcaacataaatctatgggtataaacagaaatatttagaaagctgcttgacagaataaatatatcataaaacactaacagtagctttcgaccaggtttacagtaccaggcgtgaaaccctgtggtacaggcctcatatccagtcagggagcagcatgttactctaataaccattatgccactatcgcatcagttggctcatttcaccaggttggtattgtgacacgcaggatccattgcaaggtgagacttgatgcctttttctcttccagtaactcccatagcaccttctggctctatgtaaacaagacagaaggcagagactttcctagacaggtgaattgctctatgtccctcatccaaaatgaggggtgtctgcagcaatagggtcctaccatttaataggcaaccaagagcaatggcaatacccggtgtttgtttggagccttactgaccaggaactcagagcgaggtatcccttggtttggcacttatttttttttttttttttttttttttttttttgtttctgtttaattatttgagacagggtttcactttgtagccctagctggcctggaacttaggcctagctggctttgaattcagagatacacatatctctgcctctcaagttctgaggtcaaaggcatgcaatacatgcctagcctggttagttttattgttacgttgacgtgtctgttggggcattgtcttgattgctaactgatgtaagagggcccagccctgtgtgtgtgtgtgtgtgtgtgtgtgtgtgtgtgtgtgtgttccttaggcaggcagtcttaagctgtataagaaaactaggttagcaagagcctagaatgatcctgagaatgagacatcaagcagcattcctctgtggtttctaccatacttccttgtctgtgattgagctcctctgtgagaggtggaatagcaagcatggaatagcaaggaggcctactttcaagtaacttggaagtgtaagccatataaatcctttataaataaaacactggtcagagtgttttatcatggcaacagaaagcaaaccagaacactcattagattgtaattcccagtgtttccccccttcctgcacctctattctacttgtgtctctatgaagttacttattctagctagaaatgaaactatttttcaaaatttcctttattagcaggtgcagagcaggcacatatctacacacaagtggaggtcagaggacaatcttatggagttggttctctccttccagcttgtttcacttagcatagtgtttttggataggcggtatagatcatattttcactttttttatggctgaacactatttgaagtttgtgtctcgttttactcaggaataatgttactaaggtcatatcatatttgctcaagtctttgacttcttttgggtggatacctagacatgaaactggtgggtttgtatttacctttataagaagccattatctgttttccaccatgcttgtcccatttttacctttcccaccagtaacgagggtcaagtttcttctccttgcttagtcttgtttttcatattttgacagtcagtggtggtcctagtggatctgaagtgctatctcatagtggttttggtttgcatttcccgatgactaatgatgatcaggttttcactgctttattagttgtttgttgccttagaatggtagagctgtacaggtattattgaggcatttcctctgagccatacccagtggttttgtgtgctctctctctctcttttttaaaggtgtttaatattaacgcacctctccctccactgaaagaacaagaaatgaaagaatccccttgttcgcctggctacaatcaaaattttacttcaacaagtacacagacaataacccaatgccaactcccagctatacacatagaacagacagcccaacctccagagaccggtatttaaacccagcactcgggaggcagaggcaggtggatctctgtgagttcgagaccagcctggtctacaagagctagttccaggacagcctccaaaagccacagagaaaccctgtcttgaaaaaccaaaataataataataataataataataataataataataataataataaatatatatttttaagtttatgaatgttttgcttgcaagtcctgatactttcagaagtcagaaaaggcatcagattccctggagctggagttaatggatgatttgagccaacacatgaatgctggaaatggaacccagagcctctatgagagaaactagtgctcgtaactgttcagctatctctccagtatcttgaactgttattttaaagatctgtttttatttatatgtgtttgtataccacatgtttatggaggccagaagagagcattggatctctttgggctgagattccaggcagttgtgagctgcctgatgtaggtcctggggtcctctgaaagaacagcaagtgttgttaactgctgaagcatctctcctgtcccctgatttgaattgtgaagagatgtaacgtcagtggctgctttagatttgttggttcttattttgaatttggctaccctggctacctggtgtgagttggcatcatatacttgttctagttgtaacttagttcatttattgtagcaccttgaaggctcattcatactgtgacatgtgccaggtttccttcctccataacttgagtaatattctgtttctgatatgtgtttttaaagggagaaaatataggttaggggtgtgcatgttacatatatatcaatatatattttgatatatgttgcagggtaccatcctgatggaactgttcaagtaagcaatggcaaccttgccttttacccagcacccacgagtatgtttcccagacctgctcagccggtagtcaggcatctgtgagaggatgtacacgtggagggaggttactaatgaatccgtatcggtctcctggtggctacaaaggtatgttttgaatcgagtgtactgagttattgtatatactttcctgcctcaaactggattcaattttgactttgttctgtcatttccatttataattgtctattagtaggtaatagagtgctttagaaaacttttacttatgttttatttattactgtttttcctgaatataagtgcagtgcttgcagatgccagaagatgttgtcagatctcctggtactagtctcagatagtttggtgctggggtctgaaccctggtcttctgcaagagcaaccggtactcttaagcattgagttatctctctggccctccagtatctctaatataactgttttctgcaacagacctaacttgctgtctgcaaagcatattgaagaaggggggttgatcagcttggttttcaagggggattttgatttttatatttgaatgatatcttttactgattgatttaacttttttttaaatttttttttaaagatttttatttatttattatgtatacagtcttctgcctgcatgccagcagagggcaccagatctcattcaaggtggttgtgagccaccatgtggttgccgggaattgaactcaggacctctggaagagcagtcagtgctcttaaccactgagccatctctccagcccatgagccatctctccagcccgatttaacttttaaaatgtgacataatcagacaaggctcattttcaagttactttcaaagtatcttgcagataagaacaagagaatttgagttcacataatggattcttgagatttagttatggtttcaagtattgtgatggcagcttgatattagcaaaaggacttgatactgaggttttaagtacctaattatgttagcctcgtcctcacccaaacccaacttgtatattttaacagcattccaagtcatcagaaaatgttgggcatggtggtacatgctttttaaccccatcacttgggagacagaggcaggtgaatttctgagtttgaggccagcgtggtctgccgagggagttctgtgacagccagggctacacagggaaactctcgtctcaaaaaaaacaaaataaataaataaattgccagcagaagtatggtatttaaaaaaattatttattatgtatgtagtgttttgcctgcatgtttgcttgcacaccagaacaggacaccagatctcattacagatggttgtgagccatcatgtggttagttactgggaattgacctcaggacctctgggaaaacagccagtgctcttaacctctgagccatctctccagcccccgtgttatggtattttgctgtagaaacattttagtatatttttagttatagaagacacagatctctttcactctggcccatggccccaacaaggtgggctaaaattgtagcctccttacaccagtctctgacaaagccagaagtggtatgacaaacaatacaagaaagcccgcgtgggcaaagccctagagtctaatccttttggaggtgtttctcatgcaaagagaattgtgctggaaaaattaggggttgaagtcaaacagacaaattcttctaccaggaagtttgtcagagtatggcttatcaaaaatgccaagactatcatagcatttgtgttcattgatggttgcttgaacttcatcgaggaaaatgatcaagttctggttgctggatttggtcaaaaagatcatgctggctgggtgatagtggcacatgcccttaatcccagcacacaggatgcagaggcaggcagatctctgtgagttcaaggacagcctggtctacaaagcaaggacagacagggctacacagagaaactcttgaaaaacaaaaacaaacaaacaagaaaaatcaaccaagcaaaaaaaaaaaaaaaaaaaaaaaaaacccaaacaaaacaatctccccccaaaccaaacccttaaaaagcaaaaaccaaacaacaacaaagaacctgccaaataaaagttattgctttaggtattattcttagagtctgctttaaggttgttaatgtagccagtgtttctctattggcaagaaggaaaggccaaccaagtccataaattttgacagtgggaacatagtaataaaatttcatattctataaaaacaaaaaagaagacatatatctaatgatgacattgtaagatctgtccaactttttccctttagtttaacttttagagccagagtttagtgagcttcgtttcccattattttatgtatgctgtttgtttatatattaggttttgatagttatagaggaccctcttcagcttccaatgggaattacaatcagctgcagctgcaagctagagaatatcctggaacaccttacactcagagggtaagtagttattgctactgaactgtggaacagttgtggatgtcagacaggtaaacattttccctatcatcaagggaagaaggaatttaaaagtgtgaagtactgtacatgttcacataagctatttactcttccactgtataggaaaaggtccagagggtaaatttcttgtttgtagttcacagcaagtaaatgggataaaaattacattgcaaatgatttaaaaaaaattgtgtcactaaattaccttcaagttaacttactttttatatataatagtagagttcatctttataagtttaactgttttgtatattctgatttgatgactcagcaaattttcttattttttgtatctgacaaaactgatttagatattccattttagtaagccttctaaactttctgtcatggttatatttgggttacaccagtatttttctttttttttaaagattttatttctttattatgtatacatcattctgcttccatgtatatctgcacaccagaagaaggcaccaggtctcataagggatggttgtgagccaccatgtggttgctggaaattgaactcaggacctctggaatagcagccagtgttcttaacctctgagccatctctccagccccagtatttttcttttaaaactttattttatttacttatttctgtgttttgtatgtgtgtgtatgtgtaccatggtacaggtatagaggtcagaggataattttaggaattgattatcatgtgggttctaaagatttaactcaggtcactttggcttggtgacagtgtcttatccattaagacttcttgatgaccctagtctttacatttgatttaaaaactgggtcatattgaataatttatgtgctcttcttgcttgctttactatgctcctttatattaagatgattgacagaggccatctatgcttctgaatttccatcattactcagcaccgtgttttttacatggtgttccctaaatgccaattaatctgtacttttggtgccaagttaaatattcatgtattcattttaggataatttccagcaatgttataaaagatcagggacatctagtggtcttcaggccaattccaaaggtaagggtaattacctgtatagatttgcccaaagcatgcttgtatttcactgtatcctctgtcaatttctctttaaagcacattgctttcagcatttatccattgaagttcattttgtttaactttaattctaaagtattgaatgaggcagtagactaccaagaaggatatgaaaactgtcaatttaattgtgtatgtttcttaaaaaatgttcttttctttacatgagcacaatttaacctttgatacaatgccacatgctaactttaggttgagtctgatggttcaaaaatgatgagttttttcttttttttagatttattcattgtgtgtgtgtgtgtgtgtgtgtatgtgtgtgtgtgtgtgtgtgttgcctgcatgtatatttgtacaccatgtgcatgcttggtgcctttgaagttccaaataaggaatctgattccatagaactggggctacagatggttgtggacaaccacatgggtgctgagaactgaatgatggctccaaaaattattattggtatgatttataccattgatatatggagcaatgatagatttgaataagcagcagttaaaacacagggtagtgtacttaatcatacttgttaatgagaagagaccattaaatgatttagtgtaattgaaaaagaattgcttaaaaaaaaagattactaaagagacatttttctttctttctttctttctttctttctttctttctttcttttttttttttttttttttttttttttttttttgagacacggtttcactgtgtagctctggctgtcctgtaactccctttgtagatcaggctggcctcaaactcaaagagatttgcctgcttctgcctcccgagtgctgacattacaggcgtgcaccaccaccacctggcaaagagacatttttcaaagcaaagcagtcttcctattttgaggaaatgatcatattgagcagtttttcatacagcaccaaaaacattattatttcaggcctggggagatggctgtgttgggtaaaatgcttaccatgcaagcatgaagacctgagttgagattcctagctttcatgtaaaaagctagattctgtggcagtaatatgcaaccctagtggtagtgggcaggtctctgaggcttgccaggacattctgtctagttcttggtgagctccagggtcagtgggagactctgcctcacaaaataaggtggagagggactgaggaagctatctgatgtcaacctcttggcttcctatacatgtacaggggtacctacacctaaatgttcacacacacacacacacacacacacacacacacacacacacacacacacacacacgattttaaaatattataacattaacttggaaatgagaaccaagcatttaccttgggacttagtcctcctgtcagaacatctctgaatggcttagttgttggtagttctaaaagctgatgtctcttttctaatcttaaattatcttgagctcttttgtattatctactttgagtagaagatttgtcactgaaaaattaactgaatgagagttatagaagaaaggtaagtaaaaagtgccccaatctggtcttagtctttgtcattgagttttggtaaattactcaatttggggaggaaggcaccacattttcttgacctttaaaaaacagaaagcagtcaactccagatttcccaggaccttctggctatattttattgcttttgttttggaatcttgtgttttcactagctgactaatgttaaatgacctgtgaaaccttccagtacacgtctatcccctgcctcagcaaatgcgagttgccttctcagctgccagaacatccaatctggctcctggaactttagaccaacctattgtatttgatcttctcctgaacaatttgggtgagacctttgatcttcagcttggtagattcaattgcccagtgaatggcacgtatgtattcattttccacatgctaaagctggccgtgaatgtaccactgtatgtcaatctcatgaagaatgaggaggtcttggtgtcagcctatgccaatgatggtgctccagaccatgagacagctagcaaccatgccattctccagctcctccagggagaccagatatggttgcgcttacacaggggagcgatttatggaagtagctggaaatactccacattttccggctatcttctttatcaagattgaaattcagttcggagtaaaagaatgaagttctcactagtgaatctaaggaaaagtaatccttgccctggtgattgattgactggttggggaaaatattttgttcctagaggaagaaagagatccttacttttttgttttcctctttatgtgaaaactttggagcagaatgacaattagcactaatctggcactttataaattgtgatgtagccttgctagttacacagtgaatatgtattgtttgcacttaaccctcaactgtgttaatggtccacttactgaactgactgcctcaacttcagacaagttacaatgccttgttgtgcctcaattaaaaaaaaaaatcttagactgcacctccagttgtttctgtttgcataaatgtttgattaagagatgagcattaatcactggtcgattcataagttcatgggttattttaaaagaagaccttacatgtactaggtctttctgggggttccttttctctgatacatatctatctcatttattaaaagatgaatgtttttcactggccaaactgcacattttccttgtacctgtttttacttccttgctatagtgtctcccttcttttagttacattttggtgtctgctttgtatattaaaataaggcacagtaagaaatatacatgtatgctctgctcttagtaagatgctgggtttaatttgcatagacaaagtgctgagtaatcaaaaagtttaagctttgtgtgtttatatcctgtctctgcaactcctaattaaccttgggctagcaattttacctctaggattgagctctcttttcttcccttcttccctccttgtttttaaagagtttcttcccatatataactggatccatgtaataggatagttgcaaaattctactaaggacatatctaaacatgtaacacattgctctagttttctcctcccccccccattctgaaaactagggttttgtggctatgtgttcactgtcttaaacagttcagcagccactgtacttttggcattcattggagaattttctcatatttcttagcttaaacttaaatttcttaattgtcactaaatatcttatttgtcagttaatataaggagttatttccagaagtactttgttaacaatattcaggaatatatgaaggattaaagaaggacatttttagctatcaactgatgcaactcatctgccaaggcagaaagttattttgattcttgactttcatgtccagaacacaaagcacatagagaaacactgataccattaaatgactgagggcaggacagtgttcagaagcagctagttatcagtctctttctcaagtctctgagtctttagcttagtctttattattgctacacaatcaatgcctttacaatattgttggcaactctgtcctctcatgttaagtcctataacaatagatttgctaattaggttgtcccgtagctgtcttgaatttctaggctggcctggaacttaaagagagagatctgtctatctttgcctcccaaacacttgaattacaggggttcaccaccatacctggctattctgccttttaaaacatactgtgtgtgtgtgtgtgtatgtgagagagagagagagagagagagagagagagagacagagagacagagagagagacagagacagagacaccgagagacagacgtgtattggagcgccaggtcagaagagagctttggataccctgaaactgggtgttacaggtgtttgtgagccactgtgttagtgctgggaactactgagaatccctctaccattccccccaccacccctttttttttgagacagggcattggggatttgatttgaactgaggttctcatgactgagcagcaagcactttacccattgagccatctctctagcccagatcagggactaaatgccttctttagccagaaactctgaacattcttttggcaaaggctgctcagggcttctggttactcatgatattttaacggctattatcactgacattaatatagtactaaaattcttaaatttacaaactgtatgcatattttatcactagatactgtgatgaagagccctgccaagataggctcttttagatggaggcgctcaagcataagctaaataacactaacagaaggatatgatattacctgagtaaacaggaagtgcattgcaaagaacatccaaaactctagaaatgacaaagacatctggctgcttgggcagtcacccaaaattcctctgcaaggttgaggcattcatctttggcctacaggcctagagtatctggcagactcttctatgaagcaggcattttgaaggactgtcatgccttgtattgacaaagttcagcaatcacttttttgtgtgtcctgaagaatgtctggcaggcttctatatgaagcaggaattctgaagggcagtcctaccttatcttggcaaagttaagcaatcactttcctgtgtatcttgcaagtccagtttatatagcatactgtcagcagttaaggcaaagctgtttcttcccaaatggctagccttgccacattgagagaaaactatatggagttttttaaatgcccatcattttttaaagattttatttatttattatgtatacaacattctgcttccatgtatatctgcacaccagaagagggcaccagatctcataacggatagttgtgagccgttaaaggctaggctcacaaccaaaaatataaataaatatcccacagcataaatggatgtaacacatcttaaaactaatattccacaacaggctgccacttaacatttagttttggttccattagtggttgaagagacatccgtaaatcatgcattatccaaatgctgtgaccattctgttggtccagactctgcaatggtgactcttttgtgggagcagtttagggatggggattatagacaactgagctattttcacagttcaggaagacacagaaccctttgctaccacactctggtcactaaggaattcagataggtaccaattccactgtaatacctttcctcccatggataagcctgtgaaggtctgctatcaaacagacccaacccatcatggtaagtggtgctcttatgaccatagggcatttggcaatgactgagtataaggttcttcatgccttgtaaaatgtacaaatttgtttttcaaaagagagaatatttattctccatatatggaaagcatttgcaatggaagtcaacaggcaaatattggtggacttctttttactttaagaagagtcctcagttgtcaattcaccaataatacaaagttagggtatcatctagctcaatattggtcggggttgtgtgaaccaagaacttattggcaattgcaaaagctgcaatttgttcctgtgtccattggaaattagccgcttttctagtaaccctaactatgatgtgtgattcgtatctgagttttgtccctgggtgatgggattaaaggcgtgtaccatcaccactttgttcacttgactctagaattcagaaaacaactaatttatagagatctgcctgtctctgctggaattgatggaatgggctaccaccaacctgctcaaatattttgccctgactccaaatcattcccactcttagagatttagaaaacaactttgaactttagcaacctttgaatttacttaaaacattttaaatctcttaactatgttttcaatactaaacaataaaaatatttaagaagaaaactcaaaagctgatgtccaagatggtgtgggctacttgggcaatctacagtctaacattttaacctgtaattaggacacatggcttaagaaaactcagttttcatttatatcagtaaggtaagtatgtttttggtaatttaccattcaaatttttatattttttacttttatttttcatgcctgatcaaattaaaggcatttgttagtctttataagttagtttggactaaataaccaagttatctgatgaactattgcctctctttattgtggaggtctctcctgttcaaatctaatctttatcaatcttgatggtacccatagcttttcttctcccatggaaacaaggcaaaacctcccagcaacataacatatcagattgtgaaattctgaggcttctagtgcatttcctattaacagctgatcaatttcatcattagtttgtgctagagggcctgatagacccatatgggatctgatatgtgttgtatacaatggatgatttctgtttctgattacttgttgtagttgaataaaaagcgaagttaattttgaatcatctgtaataagtccagtggtttcaacatgtaaaaaaaaaacacacaaaaaacaaacccttccgcatattgagaatcagtaactacattaagagattcaggaaaatccaatcacaccataagagtggcatacagctcttatttttttgtaactgaaccataagggctttgagccactttacttattttttcctgacctgcctttccttatttatttgcatccgtagagaatgttggggctccagaaattggtgggccttttactatatgaggaagaatccaattagttctttttataaactgaagtctcttgcttttgggatatttgttgcttatttctccaaaatattactgcaatatcccagtgttcattttctgcccacaatgagacaacttcaggattagtaaaagagatctcaattttctctgggtttattcctcctaattgataaagtatcatttttcctttcagaatcaattcagacaacttctctacacagatcttcaatttttaactcttgtgtactaaaaggttccattctaagatattattttctttctgcattagaattcctgtgggagaatgagtagaaggtaaaataactaaaacataatcaagctctggatccaagttatccacatgcatcctgtaatttctaccaaagacaactctctttgaggctcagctcatatttttcttggactatttaaatccttaccaccttctaaggtttgaaataaattagtaagttcttgagttgtcaatccagttgagtagtcatagtcagttactttcccccagcaatttttgaaaatcattaagagtttgtaattggctgagtgttggtggcacatgcctttaatcccagcactcgggaggcagaggcaggcggatctctgtgagttcgaggccagcctggtttccagagcgagtgccaggataggctccaaagctacatagataaaccctgtcttgaaaaacgaaaaaaaaaaagtttgcaattgatctctcctgatttgtattttctgtgattgaattttctgttaacctaattgacagaatttcctctttgtattttttttcaggagctatttgtaatccccagcaaggcaaaattctctccatcaaacatttttcccctaagttatctacatctgtgtcagccagtaagatatcatccatataatggtaatttttagattgaggaaactggtaatgagttatttctagttgctgttgttcaaaatattgacacaaggttgtgctgtttaacattccttgtggaagaactttccactgataactttttccctttttcttttctttcctttcctttcctttcctttcctttcctttcctttcctttcctttcctttcctttcctttcctttcctttttttggttttttgagacagggattaaaggccaccaatgcctggcactccactgataccttttaacagttgacattattataagtaggaactgggaaggcaaagtttcgtctaccctgttcttgtaaaggtatagttaaaaaaaaaaagtagtcttttaaatcactgtaatagactataacttaggtaataaagaaggcaagggaattccaggctgtaatgatcccattggctaaatcaccttatttatggttcttaaatctgttaacatcctccattttccagacttctttttttaaaagattttatttttttatttattatgtatacaatattctgtttccatgtatatctgcacaccagaagagggcaccagatctcataatggatggttgtgagccaccatgtggttgctgggaattgaactcaggacctctggaagagcagttggccctcttaacctctgagccatctctctagcccctccccagacttctttttatgacaaacgtaggagaattcccaggactggtcagttcttcactatgttgagcatttagctgattctgtaccagctgttctagttcctgtaatttttctgatgtcaatggccgtttttctacccatacaggtttgtcagtcaactgttttaaaggtcaggttgttggtacttttgaaagaccaacagctgttacgtcctctttatgtacaacctgaacagtctgtgactgtttgtgataatatcttttaaattttttctcagaagcgttcttcattttatattgtttctgagattgaaggaatgttaatatgtgtttttcattgctgtaacaaatcacgtccctgtaaattcatagctatattagccacatatggttttagttttcctatttgtccttctggctctatacatttgacacatcttgcagtttgttttatctgagataaagttccagtccttagaagctgaatatttacctcctgaagagtccaatctggaggccaagattttggtgaaattattgttccatcttcccctgtgactaccaaaccttttattttaatgtcatttatatatatgtttaactttggtctctgatcatttattgcagcttgccaaaatacttctcttctggactcttctgatttttttttttttttttttttttttccatttttaaagaaatgacttggaagtcaaaagatgagggtgtttggtgccctgaactagacttacaggtggttgaaggctatcatgtgggtgttgggaactgtttgttcctctaacattataccaacagcagccacagtggaaatttactcaggtcaaggtccatgtccccaagccccctggcagtgggtggatacatttgcatacttgcatacaggcctgagcagaaggagggaagtgaacacctaatgcctaaacttgaggcagagagagagaacaccaagggcaccttaggtcacccagcagggtctcaacaggaagcctagtcatgaggcgggacagccaaccccaagggcactgtaggtcacccagcagggtcccaacagaagctgttctgtcctttgttacattcagagcagtgttgtatagcaggactttctttggagcaccagctcccaagtaaagacatggagatttctgattaattatgaaaacttgaccttagtttagggttgttcccaactagttcttaaaattacatcaacccctgtttatatttatatgctactatctacgtagtaccacatggttcattacctttcctcagtacagtaggtacaactttctccacgtctggctggagactacctcacctctgagattccttcctagagctttcatctcttcctggaagtcctccctatgctctcctgccaaggtgtttgctgttctgttctttattaaaccaatcagaaggtgccttatgctgatgagataaaacagagatacatcttccaagtgtataaaaagattatcccacaatggtgttatttttaacaacagacattaactcttcaattactctgtggatgagtttctgactggaaatgattgaatcaaatttgatatcagggcctatatgaggcccctcgggtccttttccaatggcaaagggttatcttacctgttcctcactgaactgcactgattagtcctttgctagtctttgccacaccttctgcatgctccagaaggcttggactttctctttggattatctctaaaacaaaaattgtttctaggaaggctttacctacaatcccttttcaaatgaccttgcttaccacaattaaaacatctgacattttgatttttttagaaattacttctatcagagtatcataaatgtgagatgcaggatcagcttccaatattgctgctgccaaatctttatagtcttctagtcttttgttcttagttgcccatgaatttaatttctacttcctataggttgaatgcatacaatgtgaaaatgaccacttccttaaatctcaaatctaatatttctatggattccgtttaacttcttttgggggggggcaaggtttctctgtgtagccttggttgtcctggagctcactctgtagaccaggttgtccgggaactcattttttaactgcctctgcctcctgagtgctaggaataaaggtgtgcaccaccaccacctggcaccatttaacttgataaccttgcaggtgcctatcatctgctggtagttcttgtatagtaaccagataaactaaagttggtttccttggaaccttggctacattccaccatctcaaacctcaaagttaatgtctctcccttctactgcctgtgcatctctctatccatctccagacttcctcttactttctatggtttttcttgttcacttcctgtccactggttgcttgcttcaactcttgacctatggttgactttattgaatcctgtttataataagcagaaagctcttggcttaaaggtgtatgttgaggctgaacaacatcacaactagaaaataggtttgttttggaataatctttttgtgcactgtgaagctgtgccactctgatggtttaataaaaagctgaatggctaatagctaggcagggtttccaggcacagagaacagtaggaagaagaagggcagaaatgccaggagacacagaggaagcagtatgggcaatacagagtaaagttcaccaggccacttaaaagaaagtaggttaaaagatatgtgttaatttaagttataagagctagttacaagcaagcctaagttatggccaagctttcataattaataagtctctgtgtcatcattattggggagccgatgagcctgatgaaagagtcttgactacaaatggtgcctaaattggggcttgaaccctagaccctgagattaagagtcttatgctctaccacctgagctagctgggtttaagatataaaagctagtgggacaagcctaagctataggccaagctttcataattaataatgttctgtgtcattttttttttttttttggtgagctggtagaccaaagaaaaatccatctacacagtttttttttttctagtaaataatgcaatctttaggtttacagtgtgatcaaatatcctgccacacagaggaactgatgttttcttctggcttctctgggcactgtgtgcacagacatacattcaggcaaaacatgtgaaataataaaataattaataaacagaataaaatacagctccaaccagggagagacagtttcatatgaggaattaaaaaaaaaaaagtctactgcatttggtccctatagggaccagtgctgatctttacttgtcagttccaagagaagcaaggctagaaagtgtgagaacagcttgaatggtgaatggaaagaaagaagtagcaaatgaagcgcgctctttgccacaaaatctggaaaagaattaagaatcagcagtacttaaagtttttaagtttttcctttaaaattttttcttttaaagatattatttatttattatgtatacagtgttctgctggcaagtatcccttgcaggacagaagaggggaccagatctcatcacagatggttgtgagcatcatgtggttgctgggaattgaactcaggtcctctggaagagcagtcagtactcttaacctctgaaccatctccagacgaaagatgatttttgttttgttttgttttgctttgtattgagatagtcctggctgtcctggaacttactttgtagaccaggctggcctcaaactcacaggcatcagcctgcctctgcttcctgaattctgggattaaaggcgtgcgccaccatcaccctttttttttttttttagacagcatgtagctttgttgttcaggctggtgatcctttcaccccagtcttctacccagctagacaggttgttttagactgaaatttagctagtagggagaacaaggctggacatctaggaaaaaaacttacaaattgttagcaaagaacatgtaataaataccccagatttattttatttttgttaggatttttttttagatttgttttacacatcttagtgttttgtttgcatgtataactcatttcagcagccataacagcctaacacgtgcttgcctgaccttgccttggtcactaggaggtcagatgcctgcctcatggcaaggaaccaatcagcagttagctggtgttgctatgctttacggctctgggtgtgctttacagacaagtgcacagcaatgatgtgcagagcatagcaattgctctgggagggcctataggccataacaaccagttgaccaatcaacactgggcaagtcctccaagcctggaggcacaccaatcctgagcctgtgtgtacccctagacactccccttatgctgcccaataaagatctctggcttcttggggtcttttcctagccatccactaatggggttaggtcgttaactgcaataaaacctcttgctgtttgcatcaagtttttgcctctgcctagtgattgattggggtccccgaaggcctagactgagatcctggggacctgagcctctgggggtctttcattaccatgtacatgccttgttcctgaagaggtcagaagagggcattggattctctggaacctgcgtcattgatggttgtgagccaacttgtgggggctgagaatggactctggnnnnnnnnnntcataagcaaagtgctcctaactgctgagtcattcccctcccccccccatttatttaatgaaacattatgcaaaatagagccatggtctggagaatatgggagaggtcctgttcaggatgtagggaatgaggttcagaggtaggtacacagtgatgaatttggggatgggtgaatactgctgtcaggggctttgctcattttggtagggctctgtaagatggagtggggtacctgctaacattgttgaggtccagaacaggcagagctggttaaagacaagggacaggattgatcgatggatgtgaagaaaaagcagcactgcaaacaggtgttctttcctgcggacacatcatggtgtcgatgaacacagtagttgaattgggagacaaaaaaacaaacaaaaaaacagaaaagaatgtgtagtctgggaaaattgctcaagagctaaggaataagtgagttagagaacaggtgtagcattgttaagggaaagacagaatgggtagaaaggactacattgaagtgaggctcgtgactggaatagcaagcagcatttgaaaaactgaagccacaattttcagaccagcctaggctataaaaagagatcttgtatcaaaacacagggaggagcgtctcttagagttaagatttcacaagtaaaggaaattggtggtgggggcagaaaaggcacgatttccaactgaaaatgcatttttttataactttgatggctgcatgcataaaggactgaaatgggcaatgctggaggcaacgcgtcacagcacacgttctgtctcattttgtaactttttttttcaagacagggtttctttgtggagccttggctgttctggaactcactctgtagatcaggatgacctcaaactcacagacacccgcctgcctctgtctcccgatagctggaattaatggcgtgcgccaccgtggcctgttctcccccctttcctttgtatcttcttaaaacccagttaactgaaccaatatattgtcattatatgctcctggcagaatcacaagccttcagcagcatttgcccacatcatctttacggtgtgtgtttagaaccctcttttgggttcaccagaggaaaattttgctgatatttctatgcattgcagttgtggaaaggcaagttccttcttgcctttcacgatgaaagtctggacatttttggcactcttagacatatagtttttcttaccactgtgcttttacaccctaagaatatatacatatacttgattgtctttctattaactatgagccttttcgtacaaacttgcattgaatttcatcttgttataagatacctaaaaattatagtcttctgtttggaaaacacattttaaaaacatgttccaagagtgaatggcaagataaagggtggctctcatacactgaaggaatccccttctgtaggctacacgatttcaaggttccagcaagtttgtctcgaaaaagctcaattgttgtgcccagaggtcttgaacaaaaggtaccactccgtttagctacgcctcatttgcagcaactgtaagtagatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttaccctcactctattcttctaagcagtctcgacattgttccagtgttactttcaatatttcctatcttttttttttttgtccctactcttctctctctctctccctctctctttttttttttatttttcttttctgagacagggtctcactatgcagttgtggctagcctggaactcagaaatccgcctgctgcttctgcctttctgcctctagacttctgggattaaaagtgtgtgctgccaatctggtccaacatttgaagattgtaataatcataagctctgcttctgcacatgtaaagagggaccaggggccccttactaaaaagtacacattaaattaaaatctcctcgcatggcttagcaattgtttggaagttgctacaagtgtgaaggattattacttaattagtggatcttaaggggttgccaggaccagtctctgctactctgagaactattgggcatggggattatggggcttcatccctgatgtaaagaatctgaaaagctcggagtgggaacaagtttgtaatttaactggcttcccaaggcgattctgtacctcctacaatataagggtgcttcttggccagtgtgtctctcctggttgagtttttaaaagccggtgggttttgaatcttgaaagagataatactaaccgaaaatatgtgtggagtttgaggtatttgtgaatcccgggtccccaagagataaaggagagttgagactcctgttacggtctatttggctcttctgtgggagtgttcaaccaagaattcttgaggccctatttgatttccagccctgctcaagcctgtaatcctaacacacacaaagttgtgttgaatgaaaggccaaaaaggatgctttgatgtttcagaaacaggctgtcaccctagagtaagagacacttagagtcagtgcctgtcccagactttgtagagtactatctggattaacagtcattaggatttagttagtaagaatgccacgagggttggacttgcaacctgctggtgtgtacagtttgacttccagtttgacactgctctcaccacgttgcaagatgtccctttgatagtgataattgggaacagaactttgatgccatgttacactttctgctcatagtcaaaccttgcttacttctgatttgccatcatgtaagtgcagtttatatttggaagcagaaaaggcttggagcctgcagaaccaggagaggttcaattccatgctctcttcatagtgttttaatccaaattctgtctttactcttccctgctcccatctattcatctcaccagagaccattttcttggttacttacgttttacagtgtgaggccctaggctcatgcctgacaccacaaaaatcaatccaaagcaacaaggtaacattgctgtgtcattcattcagcaggtgcatcttgttcagtgttttggattgtattatgccttcaataagtttttgtacttgaagtagaaaaattagatatgatgttattttatcattaatgaggtgcgattttggtattgggttttgcatgcttgtcccttagcacccctgtgctatcctgtctggctgcatgaatgaaaaagcatctactgtgaggaattagagcttagagctcttttacagttccccctccaagggtctcatgtagcccaggctgtctcaccttactgtgtctccaactcttgagtgctgcatcactgtgtatggttggtgtggtgctgactctggagcttggggttctgtgcatgctaggcaaggtctctgctaactgagctaccccccccacctcttttttttttttttttttttttttttttttttttttttttgttctttcgtatttttttctgttcttcccccctcctcttccctcctccatctctttgacatagtgtcttgccatggagcctgctcctcctgcctcagcctcctgtgtgctagaattatagatgtatactgcctggcttttttatttctttggtggtataggggttttgctcatgctaggtcaacagtttactcttattctcagccttaaaacatttactttcattaccaagttctggaattcctgcttttttttgatttttcaagacagggtttttctgtgtagttttggagcctgtcctggcactcgctctgtagatcaggctggccttgaactcacagaaatccgcctgcctctgcctcccaagtgctgggattaaaggcgtgtgccaccaacaccgggctatgccttatgttttttatctttttgtggtggtgcttattggttgggcccagtatcacacatgggaggcatacaccaagctactacatccttagccatccatcatcatctttgctgttaggaatgatgagttatttgctgatttgtgttctaggcattggtgtgaccacatgttagttgggggagacaggttatgagttgtgcagagagcagcctacaagtgtgttggaataaatagatgggattgtcattttctaaggagacccggatgttgaaacaagaaaggcaggtcaggttcagggcaggagcaaagagaacaagtccaggaaggcttcatcccacccaccagctggggaactacagggattggtgggtcagagaccaggaatctcaagtcttggcattgtatgagtttttataaaacatagaatttaagtaagaaacacaacagtttattttcagaaagcttcacagatacaaagcaaatatacccacgaagtcattgagaaatgagtcatctttttgttagacacttgaagcccaaagaggaacaacgatggggtattattgtgaggggagtggcctggaaatgcatctgcatttgccctgaatgttttagcttgccaagttaacataggccaaatcaccaaagaagtcaaaagtttcaacagttccttaaaatggccaacagttgcaaaacaggagttccgaaatgtgtccaatggcagcaacagttttaataagtagcattagtctaagtgcacaggttattttgtgtctatataagagtttttaagaactgaagtcagtttttatgattataataaactgaggatgtttatttttgatttacgagacctttcactattcaaaaagctataaacctaaattatttttataatgcgtatgttgaagttgtagaagactgagttaaatcaatattaatattttccccataaaaactgctattaagctggacattggtggcacatgctcttaatcccaacaggaggcagaggtgggctgatctctgtgagtttgagaccagcctagtctacagagcaagttccaggacagctgaggctgcacagagataccctgtcatgaaaaataaaaacaaaacaaaacaaaacaaaaaaccctaaacaaacaaactgttgttcaacacacattttttttttttttttttttttttaagacttgtttttgtttttgaaaccaggtctcactgtgtagctctggctggtctggaaattgatatgtaaatcatattggacttaaagagatccacctgcctctgcctctaagtgctgagattaaaggcctgtgctgccatacccagcaaaaagatttattcttaattatattcatataattaataattcatataatgcattttaatttgtgtatttttttttaaagtctgtatgtatatgggtatatgcaggtgtctttggaatccagagtcactagaacccatggaattggaattacaggcacctgtgagcagcttgacttagtgctgggaactgaatttgcatcctctggaagagctgcagatgttctctcctaagcccctgctttgttttgttttgttgtttttttttttttttttttggctggggtttcactgtgtagctttggagcctatccttgaactagttagctcttgtagaccaggctggtctcaaactcacagagatccgcctgcctctgcctcctgagtgctgggattaaaatatataccaccacacccagttggagaagtccttttaaaaagtttcctggggcctggagagatagattagcaattaagagctgttgcaggatatttgatcacactgtgaacactgagattgttaattaatgggaaaacctgtttctagctgtggtgtggcttagccctagcacacacctttagtccaagagctttctgcttgaataaaatcaaccataggtcaagaggagcaagcaaccagttgacaggaagtgaatgtaggattaagggaaaaaaaaaaaaaacagtaagagggagtcaggaggatagatagggagacgaacaggaagtagaagggagggaccttcagtttaaagaattattttgagatggtataggagaagggagaggtttctgggatatcggatgaggaggaaggtcagttgggtgctctctctgagctagcaggctttcacctcagtatctggctcctgagtctttattggtgaaattgaatattttgttaatatttccattggatgctcttccagaggtcctgagttcaattcccagcacccacatggtggctcacaaccatctgtaactccagttccagggaatctgactcctcttctgacttctgtggagaccagacacgcaagtggtgcccaggcatacatgcaaacaaagcactcttacacatgagaatagatttaaaaattgagtggtttggcaagatgacttagtgggtaaaggttcttggccttcctagcctgatgaccagagcttcatctagaacacatataaagatggaaggagagagtagactccacaaattgtcttctgacctacacacacacacacacacacacacacacacacacacacacacacacacagacacacaagaatttttttttttttttttgaggaaaaattgagtggtttactaacttagctgtgtctcaaagggctacatggcccatatgggctttagaagatgtcaagctgaatggaccctacgcagtgttcaaggtctggtttctctccttgagaatatcttgggacttctggtagtatcagtgggcaggtcaagcggagctccagggatgtgcagggctgtgggatatctgtgcaaatatggtcagggagaacggggttctgtgctgtttgtgcccatggccagtctcaggaacagatcagagtaaacagccagtggatgaaatggtccaggcatcaggctgaacaggaagttgttatcgtggactctcgagacatcgtgacattgagaagaatgtgcctagcgacgcccgcccactgctgtccatgctgctcagtcccactcaggaccagcctctctctagcacatggaaatttttggtttttttgggcatttttgttttgtttttatttttttgagacagggtttctctatgtagctttggagcctatcctggcactcgctctggagaccaggctggcctcgaactcacagagattctcctgcctctgccttccgagtgctgggattaaaggtgtgtgccaccactgcccggctaacacatggactttttttttttaattttcatcttctttttacatttgttttgtgattttttttttaaagatcttatttatttagtatacagtgttctgcctgcacggcagaagagggcaccagatctcattacagatggttgtgagccaccatgtggttgctgggaattgaactcaggatctccggaagagcagtccgctgagccatctctccagcccaacacatggaatttttaaaaacatattgtattcgttttttgtttgtcaaaaaaaaaaaaattcacatcaagaaaattaaagcccagataatctgggaggaaacgtttgtcctgagtaggttatgttagtggcttttcttcttctagtaacaaatacccgataaaagcaatttaagagaggaagggtttactgagagtgtagtccaccatggtggttaaagcatggcattaggagcttgaaacagctggtcaccttgcagtccacagtaaggaagcagagacagctaaatgctggtgtctgctggcttgtttcttttccttcagtgggggaccctggcccatgggctgattcagcccatgtgtaatgagtgtcttcctgtatcaattaactccactacagatttccttcagaaatgtctagaggcttgactgagagttgaatgtagatcccgtcactgtgacaatcaatattgactaccacagaggtcaaataaaaggctgagatcataaatccattagtagctcttagagttgattaataaaaaatgaaatatcccctctcaaaggataaagggttttataagacatttgtagaagaaatgaatggtcaacaaaaaggcccttgagtaacagaggaagtatcatttaagatagtaataagattttgaagtttcaaaagtccttgtggtaggtgaactcccgtgcagggctagagagctacctactttgagctacaattttttttttttttttggtttttttttttgagacagggttttctgtatagctttggagcctatcctggcacttgctctggagaccaggctggcctcaaactcacagagatccgcctgcctctgcctcctgagtgctgggattaaaggcccggcgagctactactttgagcagagcattttgggaatatatgccaaacatcataaaagtactcatatttttattcattagttataagaattttttccacttaaaagtattttcataatcttcattttacctcaggatttctttaattgtttatggtttttctttcatttggacagtaatgtattctgtaatggtgtgtgtagctattcagaatgccctgtttttacaaagcatttctttgtaatttcagtcctacaagattattaattttgcccccagcttgcttcggatcatagtctccgaccaggtggagttcccagttcgtcaggcaggtaagtcgccttttcaagttaatgagagttctgccttaaatctaaatagttataatgcactgtaccagacctgttcaacgaaaaatttaataattaaaaaaacacttgtacaagatcatgacaattaaaattccagcatagatccaggaatgacccctaaagccccgcccctatgggcaagtttgatggcagttgatggttgctggaggagagagtcactctcctttggggatatgtggttgcctcagtgaatggccacacacccatgttcatagggcatcaccaatgtgactcagggctactaactatagcaacagaaaataacgaggcaatgacaatgggaagaagatgtcatctcagtcactaggggagttgagggaaggtaatggtggatggatatgaccagtattcattatccataatcggatttttttccgtcagggaccatccgctcccctgtaacgacatggagccttactactaattatgaaagctcaactgatagcttaggcttgacttaaattaacccgtatcttttaatctgtgttcttttatgtggcttggttacctttatgctgaactgcctattatgcttcctctctgcctggctggtgactccacccttcttcccagtgtcctccgtgcccggaaatcggtcattcacctttttattagaccaatcaaagtggcacatcttcacagtgtacaaaaagattattccacaacatttcccccctttgtctaaataaaaaggaaaggttttaactcttacacagtaacactatatacaataagaacaattatcaggtaagaattacatttgtaatatctagtgcatttgtatttggcagattcagagagagtactgtattaattatctaaatgtatggaacattcaagtaataaaaaataattaaaaaataaaaatcttttgaaaaatttggaagaaacacttctaagacataaaaatattttcttgctgggcagtggtggcgctgcctttagtcccagcacttgggaggcagaggcaggtggatctctgtgagtttgaggccatcctggtctacagagtgagtttcaggacagccagagctatatagagaaaccctgtctcgaaaaaaccaaaaaaatttttttttcttttctcttggaaagttagcagtagatactgagttctcacatttaccctaggtgatttttttttgttgttgttgttattttaatctctttgctgccatccgtcagttccttgcctctgtaacattgctgttttacattttaatttcccaattttagtaatttatgatcccttcatattaccttaggtcacctatattaagactgcagatttatttatctgaattctagcagcaatagtgtcaagtcacatagagacttcttattaattatgaaagtgtggctgatagctcaggcttgtttctaactagttcttataacttaatctgtatctttaagtctatgtttatttatttatttatttatttatttattatgtatacaaaattctgcttccatgtatatatgcacaccaggagagggcaccagatctcataacggatggttgtgagccaccatgtggtttctgggaattgaactcaggacctctggaagagcagacagtgctcttaacctctgagccatctctccaaccctggtctatgtttctttatgtgacttggttacctttaatgccatgtggcttgctctgtgtccctggcctcttttcacaactcctccctttttcttcccagcatcctctgtgcctggaaatcctgcctagctattggctattcagctttttattaaaccaatacgagtgacacattttcacagtgcacagtaagattattccacaacaattcctcgaagtcgccgtgtttgtgctcagtctgaagacatatatatggtttccaggtcatttctgtgtcatttaggatgtcctccagcttggtgtaatgctcctgctttgactcccacgagacactcttgagctcttcgcatttccctttcccaagttggccctttgtacctctaagggttttcatccctgttgggcgtggcatcccacatggaaggctgttcagtccttgtgctccgtgtgattgagttgacgtgatcttcctgattccagcatatctgttcttctcttaaactcagctgccatctacctgaagaatatggtgacacagtactggccagacagggagcctccaccaggagaagcgatatttccatttaatatccatgagaatgaccgacagcaaattcgtgacagcattgtggaggggataattcgatctccggatctggtgaggtaggccatgccctgtctatgtgatttgaggaggcagctggccttgactgggactgacaattgggtgtaatcttcagctttgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnngtgtgtgagtgtgagtgtgtgagagagtgtgtgagtgtgtgtgtgtgagtgtgtgtgtgagtgtgtgtgtgcgagtgtgagagtgtgtgtgtgtgtgagtgtgtgtgagtgtgtgtgtgagtgtgtgtgtgcgagtgtgagagtgtgtgtgtgtgtgagtgtgtgtgagtgtgtgtgtgagtgtgtgtgtgcgagtgtgagagtgtgtgtgtgtgtgagtgtgtgtgagtgtgtgtgtgagtgtgtgtgtgcgagtgtgagagtgtgtgtgtgtgtgagtgtgtgtgtgtgtgtgtgtgagagtgtgtgtgtgtgtgtgtgtgtgtgtgtgtgtggtttttacttttttgaggcaggtctcttgtatcccaggctggtctcaagtgtactgtgtgacccagtgatggccttgaacttctagtcctccagtcttcttctcaagtgctgggattacaggtgtataccactatgatagctgtgtgtagagttggagcttaaacccattgtgggcaactttaccagctgagctatgtctccagcccaggaaataagtttctagctccatgaattggacagcatagctgtggagtcaagcattttgcagtcttaaaatagaaacaaatttacttcaacatatgatctagtaatgaagttttctttgcaaatggaggggaagcacaacagatgaaacagtgttggtgggtgagattatttaaccagatattaagtgcagttatgatgaaaacaggagaagaaaggagatttgagggagacagcaacaggaagaataagcgttgaattgctgtgtagttatttttcttagctaggagaacacaggtgtgctcactgcagaacagcatccttattctcattggttgaccacatgctaatcgtgttcccggagcctcgcagaaccatagcatgttaatctgtgaagatgcttgtccctgaccgcctcatctcccagtggttcttagcaacacgggagtagcttctcctgtcagtcttgctcttggcttggagtgagaaatggaccatgaggcccatctcaagatgaaatcttaaaagatgaaattttagctatactttctgccagtgttgtttaaaggaacagctgctggcatttgaaggggttccctgtttattctgagacagccctctgtggctttggtctccccatgtcctaaataaagccgcctgaagactcttctttttattgcctgattttgtctaaaagtattgcagagaaacttgatttggttccataaggaaggttcaatatgctgcttacctttttccagtttttgtggatctaagttattggatattcaactgaacactagtttattgtttatttttttacagtttggaatcctgggactgaggatgtagctcagttggtacagcgcttttctagcatgagagcttgtgttcattcccagcactgcatacagtggtgtcatgtagtgtggcatagtggttcttgtgtggatctcaggactcgggatgtaggaccaggaggataagaagtttaggatcatcttcagctacatattgcactggagatcagtctgggatgcagtaaaccttctcacaattaaacagcccaccaaaaactgcaatttgggtcctagttttgtcaggttaattttctaagcaaataaccttatgtagacatacttggtaatttgtagaagggacatttttgtttccctttattttctttttaatcttaatcacagcgagatcccactcgtgattaagaagtgatgcctgcaccaagtgttgtgggataatatcttgcatctttctgctaaagtgggaggtacccctctccttctgttttatttctttggttgcttttttttttttttttttaacttatttctttgaccttggttcctagatttctccttttcagaaattccctagcaaatccatatttgttttattcaaagtacaaaaattagtgtgtacttttactggtacagtatgccatactgtctcttaacgaatgagaactatgtttttccatttgatagatgtgtgtgtatgtatatatgtataccttacactttgagaggtgctctaccagccctagggctcactccagccctaggcttgcccatttggtagatatatgtgtctctgtctaaatgtgcttgtctgtctgtctgtctgtctgtctgtctgtctatctatctatctatctatctatctcatgtatctatcatctgtgtgtttatctctatatatttatgtgtgtacgtgtgtattatttatttatctatgagtgtgtatacataaccaatgtctattttattatcccttctctttgtgtgtctgtctctgtgtctgtctttgtggatgtgctgtagatcaaacctaggaccctgtacatgctgctccttctggatatgaagacccagatataaaataagtaacgatttttatagagttgaggcagatttgctgaacacctggaaatttttttacagtctttttgaatttatttatttattctttaaaaaaaataatttatgctttatgaatactctgcatgtatacctgcatgccagaagagggcatcagatctcattacaaatggttgtgagccaccatgtggttgctgggaattgaactcaggacctcttgaagagcagcagctaatgcccttaaccactgagctatctttccagcccttggatttatttttaaaatacctttaggctgggcggtggtggggcacacctttaatcccaacattcaggaggcagatgcaggtgaatctctgtgagttcaaggccaacttggtgtatggagcaagttccaggacatctagggctgctacacaaagaaaacctgtgttgaactctgcctccccccccccccaaaaaaaaaaacacctttaggataagatgaaggtatatatttgaggagttcccccattctgtttattttcagtagattgagtcactgaggtttttaatatgatcacttttcttcacacccctcatgtatacagtcttttgctgcagaggttaacaatgtatacagtggtatcccatgtgatttacatccccttagatgcaactagatggacatcttaggttataaaggtatactctggtattcacacatttctcaatgttatctgtgctcagtggtgcctgactgtaggtgtaaagggagttagagaactttttaagaatacccatagttcttttgtggataatactcttaactgcttgcatctgggcatttttttccccccatgttacagagtccagttaacaatgtgtctccgagtcatcatcaaacatgattttcctggtcactggcctgcagtggtcgacaagatagactattacttgcagtcaccaaacagtgggagctggcttggcagtttgctatgcttgtatcagctggtgaagacctatgagtaagttcgtttctactggcagaagagagccagtgtcctgtggaatcaggcccattgagcctgagtgctgagattacaacccaggtcgtttcccttctttaagacgatagttcagatagttttatggaatttctatttagtaaatgttttaggttggcagcaccgannnnnnnnnnnnnnnnnnnnnnnnnnnnnnnnnnnnnnnnnnnnnnnnnnnnnnnnnnnnnnnnnnnnnnnnnnnncagctttcattttacagaatgaattaatatgtgatgtgagttaacttaaacactagaaaacttcctatataaaattactagatagtcttggacctttcttttttttcttcccttttctttctttcttcctccccttatttttttttccctccctccctccctccctcccttcctccctccttccttctttcttttttgttgagacaatatctctaagaactgggattgcaggtcttcagttttggactcttaaactagtcccaaccttttaagaaaggtttcgtgtctgcccaaaccaagactttattctctcaaagttccttccaactttattccttccaactgcatagaacatttaagctgcattttgcatgtttctggcttcacgtggttaatctttgcttctatctcattgagaaggagagaagccatcaccttctttattctctgtctcatgcagatataagaaagcagaggaaagagagcctctcctggcagccatgcagatatttctgcctcgaattcagcagcaaatcctgcagttacttcccgatgcctcccattactctgtgttgctacagaaacagattctgaaaatcttctatgctcttgtccaggtcagttctacttcagaatacaaccatggggcctcatatttgtgtgtctaccctgtagaaatgtcattatttagaatcacatatttttaagatttatttttattttatgtgcattaatgttttgcctcatgtatgtctgtctgagggtgccagatcccctggaactgaagtcatagataattgtgagctgctgtgtgggtgttgggaattgagcctgggtcctctggaaaagcagccagtgctcttaaccactaagtcacctcttcagcccctagaatcatatgtttttaccttaggagaatcaggctcacaaaagttaactcagtcagccatgagcactgggtatgcaaggttcagtttggtgtctgtggctgttttctcagtctcaagtcccaactcatgaagagcccatgcgttgtttgagcttagattcaaggtgccctgtctgcaggtcggctgtgattggaggaggagaggaaggaaacacagagtcctttttcatgggaagtcacattgatggccttttctcttcttctgccaacttcaagccaacacggatttagtggctccccccgggttttttggggggggggctggggggnnnnnnnnnnnnnnnnnnncatggtcagggaagaatgattttggtaaccagtgctgggccaagacttcttagagtccggcccagatcactttagccatatttaagcatggcatgattttgaaaaaagtactcagataaatgactatggcaaagcttaagacatgtttacattgaagttcttagcaaagtacatacagcttcatctgtaagatggtttcttgtcttagaaacattgttcaggataagggcctctaaggtaaacttaatgcctgtaggagtcagtattggcctggccctgagataacacagacatcacttagtctgttgtaaagtgcaggtgacatctctcacaaggaggagtctcatggcctagaagtaaagctcaaggttttagggggaaagtctgggataagcaagcacaatattctgggggatctgggcagatcctggcccaacaggtagcaaagcattaccaggttgtaaactaaattttccccagcgttccaggagaaacagctaaatatcttctccctttggagaaatgagctatatgtttaattttccctggcttctgcagtgctcatccgtgtgcacaaggcctttttgctctctatgtattttctgtgatttaagccgatccccttttcttatgtgaaactataaaggatactagtatggtagttaaaaaaataatgggaagatagagttggaatgtttctaaatttgagaatatttaacactgaatccttgaaaaacctgagtaaatgctttcagcctgggaagaactggggtcagcctgaaagtgatgtcggattaaaactgttttgtgtgctttctcaacaattccctgtgacgtgagggtggtttagttgagctggggtgacaggcgagttgggagttgttcttgttttattcaacttgggcgcctttggactattttagggttataataaagtctcctctcataagctttttgtttttattttttgagacaaggtttctctgtgtagccctggctgtcctggaactcgctctgtaggcctggctggctttgaattcacagagatccgcctgcctctgcctcctgagtgctagtattaaaagtgtggccacctcacctggcctcataattgtttaataaagtcagttgcaagcaggttttgttttcttttttctttttttttttttcaggataaaaggaagtaaggagatctcacaagagcgaagaaagtagaatatcagggaaatacatctttccacattttctgaagtatttgggaagaaagctgcaggcctttcttgtagagttagtattagagatctcctcagtaggcttactttatgctggacattgtaacaacaataatagcccatgtatatggggctggactagcctttcttcctggataaacagagcccaggtgctggttggtaacatgaaggctccgggcatgaggtttctgtggtttctttatctacttggctcactaacagggaaaaaaatattttaaacatataaaaaacaaaaaacccccaaacaaaagatgaactgctttgacatctgacatctttaactgttttggcaatctgttatatataaatacagtaatgtgctcctttggaggcataattgaaaaaaaaaaaagcagagaagcaaaactgcaatgatggagtaagaattgcctgtctggggcacagaaggtcctgatgagctgttcctaaatgtctaattcaatgagattgattatgttgtcttaagtagcatttgtctgtgtagaggtacatatgccgggagtcaccacttttggcctaaccccctgcctgcccctcttctggaccttagtttgagcccaaatgcctccctcccatatggcactgagaggaaagtatggccattctcattttttttttttttttttttttttttttttttttttttggagacagagtcccactgtgttttttggccggggggacctcaaactcacagcaggcttcctgtctcagccttctgagtgatgggatttcatgtgtgagccaccatgtctggcttataggtgtgaatttagcatccatagctgcctgtctctcctccttcaatgtttgtccttcctgctcttgaacttgggatttccagctgaagtgtgagcttggtgagacagagtgatgtctcttgtagggttatgccattagctcatagctaggaacagtagagcaatgggcatggaggcagctccctgcagctcatgcatggtatagcagggttgatggaagcctgtgtaatagtcatggtaggtactgggccacacactagaggataggaatcagaaagaatttcatgtgtgttcatgaggtgaagattttcatcagagtgcttataagtaatagtttgatacacgaagaggcaagttgtaaaataacccaaaatgtatggaataaatggaacattattgatattaaatctctctttgtaaaggtagacaatggaaacaattaatgacatatatattctttaaatttaaaagtctcatatataaaagccaggtgtaggttgtacatgtctgtaagcctcatgttttcagagtagaggtgggaagattaagattgtaaggctatctttggctctatagcatatttgaagcctgcttggcttacaaagagaccctgtttaaaaacacatccaaccaataaacctgaaaaacagagaggctggggagtagcccaggtgttagagttcttacctaggtgtatgaaacccaggggtcagtcccccgtactaagtaaaactagtcgaggtggtgactgtaatttcagtatgcaggaggtgggggcagcagggtcaggggtcnnnnnnnnnnnnnnnnnnnnnnnnnnnnngtgtgttagcctaggatatgtgaggccttgtttcctcacacaccccaagagtatggattttttaaagttaatttgaggttgaatcacgagttgccgtttcttgctccaatttatctattttgtgtattttcaccttgtgatataaagtgctgacttgtatggacaggagggtgactgtgtattgttgctctgtttcctagtacgcgctgcctctccagctggtcaatcaccagaccatgacgacgtggatggagatctttcggaccatcattgacaggatggtccctccggtatgtcagggctctgaggaaatcctgcaaatgttgactcactgtccagtctgctccctggaaaacaaaacaccactatcatagtaaccagtaaaaaagtgtaatacatgattagtaacgtttacagaaagtcagatcagcaagaatatgaaagcagtaactatgtttgacttaagctggtgaaacattttaaaccttgctacatatctctctagtctttttttcttggatgtgtatttagaattttacttctcaaaatagtacatgtagctgtaccttcatattttttcaccaaaaatgaaacatgaatattattaatacttttctggttataacttttttttttaaaattagtttttattttacatttaaattttttagtgagtgtgtatgtgtgtaggtggtatattgtatgggagtacccatggtgcatgtatagaggtccgaggacccttgtggttctttctttccaccatgtggatcttggggatcaggctgaggtcattcaggttggtagtaggtacctttacctactgaaccatcttgcctgcccttgactgttttttttttttttcaagatggggtttctctgtgtggcttgggagcctatcctggcactcgctctggagaccaggctggcctcaaactcacagagatcctcctgcctctgcctcctgagtgctgggattaaaggcgtgcgccaccaacgcccggctcgattgtttttatactgtcgttttaatagggtgcttcattgctagatatttgggtagttttcatgtttaagctattatctataagaatgtgatttagtgccttggtggggtgaactctgtggcagagtggttgcttcttgaaaaagtgttgggctttcaacagaccttgcaaagccgaaacaatgctcaagcatgtactttagtaaaccatggccgagagtgtttgctgcaagtgcacactgattctaaactacctgttttataggtaaaagtatcaaagtgtggctgtggtagcaacaatagtgctacgtttcacctgtcaaattaacctttgtattttaaaaacttgagttggcctgaaatgtccactattctttttgtgtccattccttttatttacttacatatttaggttgagcccaaggactctcacatgctaatcatagtgacatatcttctccattgttcatacatgaaacaaattatttcaagttttaatgtgtccacagttcagtgatttttgccaacagtcttgtttgtgttgactacatcaaaactcagaacttttctcatcctctcagagttctgtttctgcctacttgcttcccttgaagataagtacaaacaccagcactgcaaggaaagatttgcttaacttactgaattcttttttttttttttttattaactaacttacttcttaattagctacctgcaaagtagagtgtatattcacatagcaagtctcacttcgaatagctatggcttaatctataccaaaatttatgccatttttgtcaaccagcctaggaaaaaaaaatctgatctggatgtttttcccgtcttaggagactcttcaaattgatgaggatgaccgaccagagctggtgtggtggaagtgtaagaagtgggctctgcacattgctgcccgtctctttgagcggtattactcctcttactgtgttaatggcgttacagttggtatcttggtattgggtatactagaagtgagtggctccctgatgttctacagagtacgatttttgttttgttttgtctttaaagccatagagagcagctgggctgggcctaagtgacatatacgtctattctaagctgtagggaagtggagggaggagggtcatggatcgaaagtcattctcagctactcccaacagtgagttggaggccagggtgagctataggagaccctgtctcatacaactgaaaaccagaccaaaccaaaccaaaaacacccacaggtggcaaagctttaccagctgttcaaagtaggcttgtgcccactgccctagaaatcataacaaagtgggtaaccatctctgcctcttttctactctgtgcaaaaaacatggagaactttttatttttttccccaccagctatatacagaaagtatgtaaggtggcgcacatggatactcggctccataagaaagtcaaatttaattttaaaagcttttattgaaaaacatgtcaggcataatatttttattcctcctaggagttaattggtttagaaattagaaatttctgttcaaaatgttaactgtgctgcagacctatgaattcctcctgattcatattgtatcttgtggagaaagagaacatgctagttttctgggccagtggaagacatcttttaatatctgtgtttaaactagcaaggatgctgtgcttttaaacttcacagtacttagatgtttctttttcttgaattttaaggtatggaagcccgggaaatgtcacaaaagaatacttcgaattttctgaattttttttgaaaacctatgcagtaggaatccagcaggtaataaacttaatgcttttaaaatagagggatggttgttattgagtgctgcttctacctgttgcttgcttacatggtaattcgtcgcacactcacagatggggaaatggcagctgtgggaatctgacacagggcaaccagcttgagaacccaggggcctctatgacccctagacttgtgaggacacctcagatgatggtgtagacctctccgtgttcttaccagtttccagtttctctgagctttcccttgtctatttgaagatttatgcagtgtgaataatctatcccaacagcagtctagcttagatatcaatgaagactctcaggtaagaacatccacaagttcttggaggttggagtatccagtccacataaggaaaatgtggaactcaggagactgttgatgttaatatttaaaaactttaaaaattgcaaaggacagtgaactctgattggtccatcaaatattgccaactgagccgtgatatgtttgctatttatatttttaaaatgagagttagtaattagtaattagctgtgccagggcctgtatagggaagctaggactgcttaatcagacataatccaaggcttcagtgatgcagaaggtatttataggcttttcataaatcagtaatttgaaattaagtacttaagtaagatgtaacaatttctgaaaagtactttgatatggtacccatgagatactctgtaggggaagttaataaataataagtgaaattatctgtccagatattcagttgtctctctgactctgttctgccgctgttaaactccaagaagtgtcttaacattgatgcctcttgaaagtgtgtttagaattttctagtatcatttacacatgcatgtgtatacttgtattaaaaaacacatgctgtgtccatgtgtttttgccagaaatgttacccaagacatatactcttgatattgaaaattagtttcctggccagagatgtcatctgctgctgtcttcagtctcctctattgctgtggtgaggaccagcctgcatcggctcagggatagagtggcatccaatggggtcagcggactaatacctcaacttgacttttctatctgagggagtaaaacttaactctctggggctggcaaaaaagagaaacacacacacatgcacgcacgcacatacatacatacacagacacacgtcttaaacatgtcaggatctcacatagggtgctgatgaatggcaagccttcagcaggtcagagaaactgaagaggagatgcagagtagagtggacagacaaacagacacacaggacttttctaggccaaagtttcttcattttatcattcttactgttgtttgttctactctattccttttctgttctgtttttccaccctgatgttttccttctctcttgaagtcttccttctagcttttcttttacatctttcctggtgttttccttctctcgtgtttttatttttccctcttagagcttatatacataccccagtagaatctttcaagcaatgtaaaaggtacaatgtggttacatactgtttttcaagtgagtgattacagtacaagtaaaaaacagcatgtttttttatatcccttacatgtttaaacaatttacgtaccacaggtgaaaaaacaagtcatcccaagaaactgcatactttcatgtccaagcaacttgttatagattaacagagtgtactcaagcaaggtgttcttctcagccagttgtttttgctggcaggcttcattttgtggtttcaaagaaaggaccagttattttattatttgtttcagaaggcaatcttataagaaacatcttaaaggaatcacaactctaaacttttatatatgataaacagtcagttctactttaaatccccagggtgcacacccacttaccagtagtttttatatcaggaagctgagggcagaaatgggtatagcaagaaaggtacatgagccagcaatagccaggctgtctttgttcttgtttcctgacctcaacgagtccctcgctcagctattaaaaataatgcctttaaattgttttccgccaggcgttggtggcgcacacctttaatcccagcactcgggaggcagaggcaggcagatctctgtgagttcgagaccagcctggtttacaagagctatttccaggacagcctccaaacccacagagaaaccctgtcttgaaaaaacaaaaaacaaaaaaacaaaacaaaacaaagaaaatgttttccaagggttttttttttttttttttaacctcaaagccattaacaaaaacatcttagtttaaccttacgttatttttaaagttttgtttatcgatgatgcacactgaaacctgtgaacacatctcccaacattaagatttaaagaacttgagttagcctagtttctgggacgcagttgttttccttaatcattaacctaagccacagtctatacggctcctcaagaaaaactagctgtgtgacatttccatgttctaattttctgtcctttgtagtccctgctttatcagggacaggggcaaggacagcacaatatcttgttttttacctgtattagttttcccactaagctaacctttatcataatcccttactatatttgttaaagaccctcaatcatcaaaatcttatttaaattaacactattattatatataatcattgcttcaattaagcagtacagcttaagaggaaaccatcttcataataatacacaggtaaaaatgcccagtagaatgggatagtcccatgagataatcccactacatttaaggcagtgaagatctccccagacccattcaaaccatgccagataccagagaaaaatggcagtggcaagagacacagcagtagcaagagacattctgggactgagtctctcaggtcctagcctacccaagattcacccatcagtgccttgcatgctggtgggttgatcccctgaagttagttgccacctgctgctcctctgacttggccaccatacttgtttgaaccccagtagtgtcaggacagccctgggcaatatcatcctctcagctgccactgcgagagtttctaggtggtagctggacttcagaccaattttattaacctagattttaggtaagttggataaaattcatattctaatttataaattttgtatatgttttgaaagatttagcaactcactttaagcttgacacaatgaagtgatggggaccaagaaatgggaggcattgtgctgtctctaaaggcccttgagtcagtcacagccacttttcaaggttctttcttataaacaagaatgtaaatcagcccataagaaaagtccaattttgtcttatgttacagaggttgtcttcggcctgacattataaaatacacatatcctacattttcttctaggaactccatactgttaaagtatttatctttctggagtttattttggtgtgaaggttagttggggatctagtttaattatttcatagaataattggttatatcagcactatttttataataatgtttatcttctgattaaggtctaagtgttggtgctgctggtactgtgtgaacttgtgatgctgtgtgattatatagaagttttgaaatgtttatttgctcagtcagatctgtaattttattgaaaataggagaagctagctgtcttagtcaaagttctattgttgtgaagaggcaacatgaccatggcaactcttataaaggaaagcatttagttgggcaggcttacagttcagagggttagtccattatcttcatggcaggaagcatggtggcatgcaggcagacatagtgctggagaagtagctgagagttctacatctggattggtaggcagcaggaagagatagtgacactgggcctgccttgagcatctgaaacctcagagcccacccccactatcttctatcttatttcctccaacaaggccacatctactccaacaaggccacacctcctaatagtgccacacccgtgagcctggggggggggaagggggcattttcattcaaaccagcacaccagccatggactagaaccatagacttattctgagtagcatataggttagaagaacaaatgcctaaaagtcagcgagattatctcttagctcagtgaaacacacagaccatctaaaagatgaaacatgatctgcatgagctttctcagcatctcccccaaatctgcttgtgtagatcactgtctctacagcattgtatgtcatgtctcaagcactcctttgctctttaatgtagtaattgttctatgtttgtcctcccaatccctcctgttttcctgtaggtactactaaaaattttagaccaatacagacggaaagaatatatagccccccgtgttcttcagcaagcattcaactatctcaaccaaggggttgtccacgctgtgacttggaagcagctgaagccacacatacaggtcagcgttggtcccggctctctccaccatggtcggttaagttgggttttgctagagagagcaggtgttgttccctcctatgtcttctactgaatctctgttccccactaacaatagttactaacaagtgctgtcttatgatgaagggcttccaacgtgtgaacatttgagaagagagagattgtgagttgggaggcttggagtcaggtgtcagtcattttatttagcctcagtgtctgttctgctaaggcagatcatgatgttttcttgacccttgtgtgaaaacattttgaaagctgccagcagtactttacaaagggagtgttattttgcagaggatgaagtctgatcgacgacgacttttcttttgtggatatgtgccagaaggccagtctgcctccctgcctccctccctccctctctctccctctctgtctctctctgtctctctctctctctttcttggattcagttctttagcataagtggaagttttgtttatttttttaaaaaaactttatttattatgtatacagttatctgcatgcatgcttgcacaccaggtctcattacagatggttgtgagccaccatgtggttgctgggaattgaactcgggtcctctggaagagcagtcagtttaagtgctcttaacctctgagccatctctccagccccccgtagttttgttttattaaaaacagctttatttttattattttttaaaaagttctattaaaacttatcaatggctgtttttaatgccaactttttttgttgttgttttaaaagacagaattgttatttgtcataattaaagagcaaatcagaatggaaaatgatggaccaataatgtacacattttatttgtacataaatatctgggtaacttaaagacatttagaactgaccctccacttgcaataaactgtgagttcttggcgtcaaacttttttttttttttccttttgagacaagaccaggctggctttgaactcagagagatctacctgtttctgccacctgagtgctgggatgaactcatgggccaccaagccaggtttataatattttttttttttttggtcttttgagacagtagcccagactgacattgaacttcctgtgtggtgggcgatgaacttgagcttctggtcctcttgcctctatctcctaagggttgagactgcaggcatgcacctctgcccctgcctgtctggtttatggggtgatgaggattgaactaagggcttcgggaacctcatgcatgctaggcaagtgctccgtcaaactaagctacattcctagccccttgttcttaaatcctgtaagttggtatgtgacaagaaaaatcagttgctttacctttcatggtatctatgatagagtttaggtagtattacctttttttaaacagtgtcttgctgtatcgtttggccttgaccctcaccatttttcttcttccactttctgaatgctagaattatatttactgccacactcagctttggttagcattatctgaacacaagtcttacacatataagactttctaaaaaataatttaactttattatgtgcattgattagtatgagagtgtcagatcacctggaacaggagttgcagacagttgtgagctgatacgtaggttctgggaattgaacccaggtcctctggaagagcagccagtgttcttgaaccactgagccatctctccagctctgtgcattagcttttaaatttgtgaattatggattctttataactgttttcctactatgaccaaaaagtggtaatttctttgcaattagtaaagattttgttttcattttatttactttgtacctgtaaatgtaaggctgacatgaaatactaaatagcatctttccctttggccttacttttttatttaaattctttaattactactcatttacatatccatctcccccattcccttgccctcccatcctcccatgttccccaccaaccctcccaccagggaacttcaaagtctgtcatatcatttgggggagggcctaagccctccttgctgtatctgggctgcaatagtatccctccatagagaatgggctcccaaagtccatttgtgctctagggttaaagactggctctactgttggaggtcccatagactgtcttggcctcctagctggcacccacattcagaaggcttggtttggtccaatgctgtttccccagctttatgactagggtctccatgctctcactaggtcaggtcaactgtttctgcgggtttctgcagcaccgtcttggcttctttgctcatctctcctccctctccacaattgaaatccaggagtatgattcagtgcttagctataggttcctgtttctgcttcgaacagctactggatgaaggctctaggaatggtaaccaaggtacatatcaatctcataggggaagggcatcaatggcatcctctccaccactgcctggattcttagttggggtcatccctgtgtctccctctatcaaggcatctcctttcttgccctcctctagtcctcccctgtctcaggcctcttgatctcctccccttctccccttctccccttcccatctccttcctgccccccccctcgctcccacttcgttcaggggtttttgtccccctccccttctttgagggactatgcaatcttctcttggggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctttctccacatcctctccaccatagactgtcattgtgtttttgattttagccgttctgataggagtaagatggtatctcagagtggttttgagctgcatttccctgatggctaaggatgttgagccactttctcaagtgtctttcagccattttagattcctcagttgagaattctctatttagttctgtactccactttttaattggattatttggggttttggtggctatcttcttgagttcattatatattttggtgatcagccgtctgtcagatgtggggttgttgaatatcttttcccattctgtggactggtgttttgtcttgctgactgttgtctttatttttagtttttttattttttatatatttgaattacaaacaagattgaattacatgacaatcccagttcccaaggtgaggtcaggatgactcgggatgggctcttaaggggccttgagcacatgggaggccccttctctctggcctccctgccttgcgctcctggtacgctctggcttgcgtttggctgatgtttatctgaataaagataacttaaacctacaggttcttgctatattggtttttctgttgttgaacgtggtcttattctgtcatattcccatcccttcttccagtgggtgcacgtggggtctctccccctctcagaaggcaggaggagggcagagggcggagggttgataaggttgagatgtgtttggactcagggtgggccttcctgtctgggcaggtccactcttgtccgggggaggctcaggaagaatcaagcagggagtgatgggataggttgggggccctttggccttatttttacatagcttttgcataaaaactttcaggaaaatactgacatttaggccgaagttcaactaagtgataagaaatggtcccccccccttttttttttaaagatttgttttcattttgcatgtatgggtgttatgccgcatgcttgtctgtgaactgtgtgcatgcctggtgcccaaagaggccagaaagtctttggatgccttagaactggagttagatggttaagagcttccatgtgggtgttgggaatagaacccaggtcctctggaatatcgccgagccatccccttagccccggtcctatttttatgcgagagttaccagaacacacagggcctgctttagcttagctgctgttcagaggctgcttaggaaacttcctgtctgaaacacacagctgtggagtagagtactggtgttttgaaaatggaagcagagaagacacaaatattgttgatgttttgatgctttggaccaacatggacacatgaaatattttcaacatgagaactataatagtaaatataatcctggtggcatttttcttcacaagatatcacggtgtgtttaaagttgacctgtcagtgaagttctgtctgttgttcctgtcctcacttcagggagcgtcacttctctgcttctagcctccaactcctaagtgttcagtcagttcgagtctcagctattgtcctctctggatgtgaatgcaggctgagaaggttcactgtaactctggggaaaactaatatcgggagtcttgtcgggatggcctgtccccaactcttttgtttgtttctcaccttagaacatctctgaagatgtgattttctctgtgatgtgttacaaagatgaggatgaagagctgtggcaagaagatccatatgaatacataaggatgaagtttggtaattgaattttccctcagcactttctggatatataaatacgactaatttgctctgtctggtgaactcagaaattcagaaaagtctcatgttattttgcaccaaggtgcttgatgccctggggtgccagagacacaagaagccttatccatctcttgcggcagagctaaggcccttgccgaatggtttgggtccctgcccatgtcagaagcacctcaggcttgatttgctttctccttccttgggccacgcattccaccagggatagtatttccctcaccaactaatagtttctttttggtggctttttccagacagggttcctctgtgaaactgtcctggttgtcctggaacttgctttgtagaccaggctggcctggaactcactgagatccacctgtctctgcctcctgagtgctgggatcaaagtcgtgcaccaccaccatctggtttaattctggcatctttacgttataatacaataataaacaaaaccctttcgtgtttgctctcagcttgtttgctatagtgactatttacaaacttcatcaactggggctggagagatggctagcaattaagagaactggctgctctcccagagaatccagatttggtttccagcacccacaaggtggctcagatacctgagctatattgcttttctttaatcttaccacttgaaaggttgagcacatggtgtttgctaaacattaaatcataaattagattgtgcatgaaaactctgggaccatgacatctttattgtgtaatccactggccaggtttaaagtttgcataataaagagtttattttttattaataagatttattttgacattttagatatttttgaagattatgcttctcccaccactgcagcccaagcccttttgtacacagctgcgaagaagaggaaagaggtacccagtggatggaaatgaaaagtagctaatgttgctttgacgttctgatatgccctcagtatttaacagttcatatcattacctatagcctatcactttaaataggttttttttttttttttttttacaagtaaaaggtcgaagtatctttgacacctttctcatcttgagctcatagttgatgaataaagcacagtaaaatggctttaattttgaaaattaaatttgaaaatgtgtgtcatatttaacgtggtgttgacaagatggagactggtgcggactgaaatggattcttctgtttctttaggtgttgccaaaaatgatggcgttctgttaccagatactaacagacccgaactttgaccctaggaagaaagatggagccctgcatgtgattggttccttggctgagattttgttgaaggttaagacttatcaatctcctttttttttcatatgttagagggtatttgtgtagtgtatgtgtgatagtgtgtgtgttcatgtgtatacacacacatggtttagaggccagagtaagctgtctgtatgtatggctctccactattcatttttgttattttactttatatgtatgatgggtatttgtctgcatgtgtctctgtgtactgtgtactgtgtactctgtgtacagtgcatgcctggtgcctgaagaagcgaggggaagatgtcagattcgctggaggttatgaggtaccaaatgagtagtgggactgaacctgggtcctttggaagagtagccagtgctcttaactgctgagctatctctctagctgctatgtatttgttctcattagcttggaacttaccaagtactagactgtggccattgagctttggggatctgcctgttgctgccctccccatcacccccacgcttggatcacagatatgcactggtacaccattactcctggccccgcttgggaatctcagctcagggcctcatgcttgtgtggcggacatgtcgccaaatgagccgttttcccagctcagatgatcaagacttgactttaagctgtgaattggctcaagccaaccaaagcttgaaaattcttggtgactaattctaattgattggctttaatgtaaatatcctttcctttataacctacatacgttttttaaaaatatacatttcttattttatgtttgggttttaaaagtatctttattatctttttttccaatgtaacatttttattgattatttgggaatttcacgtcatgtaccccaatcacactcacttcccagtcctcccaagtctactccccacccttttgacctctctccccccaacagaagaaggaaaagctttcatcactatattttattcacttactttgagtgtgtgtgcatgtccctttgcgtgtgtgccccaccacacagggatggagttcggaggacaacctgtggggttgggagtcagttctctcctgtctccctgtgcatcctggggatcaaaatcaggtgattagcttggtggcagcatctttatttgctgagccatctcaccagctctgtcacttactttcttagctaaaaagaaaatttacttttgccagtttaccagtttgaaactatagctctgtaagaaagatctgaaatgattttagtataattccttctatctacaaaaaccaactaatataaaaattgttctaagatactattcctgagtaagatactattttaacgatgtgatgtgtggatcaaacaatcttacaaaattgggtatgaaatgcaagtcatcataagcacactttttgggaagtggctctcccatatggtggcatcattggccgctaaaattggctttctgttctttcttaacagaagagtttattcaaggaccaaattgaactctttctacagaatcatgtgtttccattattattgtctaacctgggatatcttcgagctagagtaagttttccttacctctgttacgcatcttaagatctcacctgtagggtagtttctgaagtgaatgtgatgatttggttaaaaactttccatgtgtgacattgtcacagggtgctgtcataccatggttgctccttgacactcacagaccgctcttctcccagtcactgtcccctgacactgtcacacagcactgccatcccagtcactgtcccctgacactgtcacacagcactgccatcccagtcactgtcccctgacactgtcacacagcactgccatcccagtcactgtcccctgacactgtcacacagcactgccatcccagtcactgtcccctgacactgtcacacagcactgccatcccacagtcaccgtcccttgacactcacacagcactgtcatcccagtcaccgtcccctgacactgtcacacagcactgtcatcacagtcaccgtcccttgacactcacacagcactgtcatcccagtcaccgtcccctgacactgtcacacagcactgccatcccagtcactgtcccctgacactgtcacacatcactgtcatcagtcactgtcccctgacactgtcacacagcactgtcatcagtcactacatctcagtcaccgtcccctgacactgtcacacagcactgtcatcccagtcaccgtcccctgacactgtcacaccacactgacatcacagtcactgtcccctgacactgtcacaccacactgacatcacagtcactgtcccctgacactgtcacaccacactgacatcacagtcactgtcccctgacactgtcacaccacactgacatcacagtcactgtcccctgacactgtcacaccacactgacatcacagtcactgtcccctgacactgtcacacagcactgtcatcccagtcaccgtcccctgacactgtcacacagcattgtcatcacagtcactgtccccatctctcattgcagtcctgctgggtgctgcatgcatttagttccctgaaatttcataacgagctcaacctcagaaatgcagttgaattagcgaagaaaagcctgattgaagacgaggagatgcccgtcaaggtggaagctgccctggcgctgcagtcactgatctctaaccagactcaaggtgattcccatgggtcttacttttttttttcaataaatggcctaaaataatctcatccacttccttccttaaaggaggagatttctagtcccaagggcccagagtttagattccttgcctgcttctgaattttgtaggcactttctttgcctatttagcagctctgttgtggtttccagttaataattgctgggtactgagctgggccttaagacacctggaccagctttggtgctctctgactggccacatgaagcaggaaaggcatccagtttcctgtctgaagcttacaaagctgacgaggctctgaccctgtcagccttcatttcctcctgcctcagttcaaggagtaagattgggcagcaccaagattccactccagggtctctgtggttctaccagttcagaaagtagtgagtggtatttccagtgggcagtgacacaggtgttttgtttgtttgttcaagatccaaacagcctctgcaagtaaattcagctttacgagaacatgagcttgtgtcctgtcttgttgggaagattggatgaggtgtaaacatgtgctggggttgggttgggtagaggtgggtagaggtgggtagagacgggcaggacaggggcaggggggggcggccgtgggcaggagttctcacactggtcatggggacccacagtcaggctgacgacacgtttgtgtaattggaatttctcagggtgaggatacagagctgttggcctttggggtaggacagctcttccccaccctgatgctgtgtggcctcaggaggtctttactcaatacagctttgggacttgctcagcacagcacagcacagcagcatctagaaccttatctaggagtcagagtgtgtgagttcccaactcttgctgtgtcatttatctgcctgcattagccaaggagcacatgagaccacatgtgaggcccatcatgcaggagctgctgcacattgtcagggagacggagaatgatgatgtcaccaacgtcgtccagaagatgatatgtgagtacagtcaggaggtggcctccatcgctgtcgacacaacccagcacttggtaagtgttggaggacttccactggggaggctgaacaagcctctgttcactccaaatagggcactggtgacagactaaagaaatgatcctattcaaatctagcttggtgaaccagtgagcttattggggtgactcacaggagagtgtcactcacaaggcaactgcatccctgaaaagcctgttcgtacatgggcaactatgaaaactgcatccctgaagcctccctgcgtaactttgaggcaactcactctctccccagcacttgctgtctttataatttggagaggagccttgtgaatcttaagaactttctgaattccctttgtgaaccttcttaagttttgtttgcttcctgagtcttataaaccttcctcttcccttccactctctttacgaagaaatatttgcaaagcaacagtaagaatgacctaagtgtgtactagttttgtaaagaacccacatgccagctcacaactgtctgtaattccagttccagtggatctcataccttcttctgacctccacggcatcagccatgtgtgtggtatatagacatatatgcaagcaaaacacctacacacatttaaaaacaaaacaaaacaaaaaaacagccccaaggaatctaaataatgcccctcccccaataaattaaacttcagaatttggaattgagttttatttatttataaacaatcttaatatgaaagtatttgccttagtgattaagatgttcctgaggttgggttgattagccttaaatcaaccccattcaagacagtccctttcacctgtaaaatcctgaaatgccataataacactcttgatgtgagctaccttaactcttccttttgcacttggaattggaatttcaattcccctctttggaaaatttaaaagttatttctattgtttatgtacatggtgttgtgtgtgtgatgcagaatgtggaggttagaggaaaactctgtagagttggttttctccttccacctttatgtgtgttctgaggattgaactcctgtcaccaacctggtgtaacaagtgcctttttccaaataaccatcttgccagtccaggagaatgttttttgctgcctctttgataaaaatgttcctattgtcttctcccctcttctgtacttcttaatgcagacaatcagactggaactgagtcccactctcatgccttttctcctctttttgtctgtgtctttgtttaatctctgagtgatctttgatttcatcttctaaatgttctgtcacatcttttcttttagacatactggttttcagtgtttctagatttcgatttcgtctaaagataactagaagttaagtaaatattagtccatggttataatagctactatgtgtctcatgtcagtgactacaatgagtgcagagggatgttcatataagtgttgacatgatctgtcattgcaagaaaaaaggcgattcagtcaccaaagtgttagaacttagtgtctgagaaacattagcatctgggtgtacaacactgcccctccaccatggtgcaatggtaccagccagtgagtgttctaatgtcatttttacaggctgagatatttggtaaagttcttcaaagtgatgagtatgaagaagtcgaagacaaaactgtcatggctatgggaattttacatactatcgacaccatcttaacagttgtggaagatcaccatgaggtgggattccttgtgttttattatatggttatattaaccgaaatttatatgaccagtggttatgaattctagtctttttagtttgggggtgtgtatgtgcgctagccatggcatgtgtgcggaagtcagaggacagctcttaggagtctgtttgcaaatgtttttttgccctttattttttaaatttatgtatttgttgtgtttatattgactgtatgtgcacatgtgtgggggtgccattagaggccagaagaggacattggatttcctggagttggagttataggcagttgtgggccacctgacctgggtgctgggatacaaacccaggtcctctgaaagagcagcaagcacccttaaccactgagctatctctccagcactgtgacccgtgattctacctccttatctgtatcaccatcctcaagatttggtattaaagatttatgtttagttatattggtaaattttaaaaattgttctcacttcagcatttatgcaggaagatttcaagtccgtggccagcctgggctaggtagtgaaatcctttctccaaacacacagacaaataaattgaatttctctcaaactttaaagtcatgtgttaagatgatcgaggaggggagtttcacatttattgaaagtaatcgatataagcctttgtattgatctgagtccaggtcctcgtatctactgtgtgccaggctgggtttctgtgacttccagatagaatagaataagggacttgccttctagaaacccaccgtctaatcttagtggggaaggtgcagtaagaatggagaggtaaacaagaacttgacatccaaatcctagaggaacaccgagtgatagaattaactgtttgagacagggtgtcatgtcacccaggctgaccccaaacttactctgtagccttcaactcttgatcctcctgtcctacctttccccttatgttgggacaaaacaggtatatatcatcagatgctttttatgcagtgctgggggatggaacccaggtctttctgcctgccaggcaatcactccaactgagtcagtcacatcaaaggcccaggggtaagagtttggactttctgttcagtgctcaccccttagctggcggaagaatgccgataggtaatggagtctcctttgcagagacagaaatgtttagggttattgtacctggtcacaataaccagttataactagttataacgtataactagttttaggtctagatttgtcactgggccactcttgtcacacattggcttttccaacccacagtccccctgggttctcctttccaaggggaacatggcctttccttagtgaagattagcagtgtgtttgttgcatctgtgaacacaggctgcttgtgttggcaatgacgtcagatctgctcagtcagcgagggtttggaagcaggtaccagctcttttacagtgtgctgttagccatgtgactacaggttcatccgtttgtaaggcaatcaagggatattgcagtgttactctgagtagggcaacattactccactggaccctcctgcgacttagggctttatgtgagcttcaacttccatattcgttttatttttgtgtttccatgttgactctggtcttcttggtaacagcgagtatagtccaaattaacttagaatagctatactttaagctaactatacttctttcaccttgtattttcaatttcatgagacctgagaaatcactaaattcagtttccccaagtatgggtatggtgaggagagcaaactgcagggttattttggaaacaatggcattttgccttttgcttaatcttttttgatcttgatatgaattgttttgaacttcaactaatgttgagcattcagagttaaccataattatcaaaggagacatgagttaaagttgagacacactaagaaaatcacatctggcttcctgtctagagatgaaaatgtaaaaccttcagcacaattagaggcaaacctgcctgagatctggcacacctggctgccatctggcctcctggtcacctgttcttacttagctcttttgaagcttataatatataatcacaccatttctctcttccctttcctccctccaaaccctcccacaaacccccatttttactccttttcacatttatggcctctttcttccttgttacataaatatatgtgtattttagttacagatgtgtgcgtgtgtctacatgtgggtatgtgcacatgttcatggatgcccctggaaggtgcattgtctacccaggagctggagttactacaggtagttgtgcactgcttgacatctgtgctgtgaactgaactagttataacctgtaactagttacaggtctagatcttgtcacacatgagattttccaacccactcttaactgctgagatatctctcctgccccattcattaactttgaacttcactcagtgaaagtgaactctggaagccatacttctttcagagaaaaacataccaatggttacttagaaagggcaaaattggaaatctgaaaataggtactcaagcaggttcatttttatctgatgttttaaggatatcaatagagtctagcttttggatcatttgaacttcaaaataatagtttaacatttatcaagttatcaaactgtacctacaaatgattatttcagttaaataagaaatgtccaaaataaaattaaaattgcatattagaatatgttctaaggttgaattatactttgacacgaaagtgtatctcactactgactttaaattttattcatttataaaacacctgatacaaaagccaggaatactgttgtacaactttaattccagcacttgggaggcagaggcaggcagatctctatgagttcaaggccagtctggtctacagagtgagttctaggaacagccagagatgcatagtgagaccctgtcttggggcaaaaaagaacctgatacggcagttagtctctgaagaaaaggcaggaaggtgtatctctgaatttgaggctagcctggtctactatagtagatctcctgtgtagatagtgagttctaggtcagccaggctatacaatgagactgtctgcatgtattgaatattgaataattgaaatcatgaagatatacttaattaaactcactgtttattgggttcttcagttaacccagttctcttcccagagtggtagttttcatcaggtgtatttatttatttatttatttatttatttatttatttatttgtttttgccacactagtaaaaagtgagtgcacgtatatgtctttcatgaagatgatcatgaggattttgctaaaattccttccctgggggaggagtgtgaaccacatccacctccctcaatctaaggtccctttgacaaaccagagtttgtacccgggagaatcatttagtttattgggcttacaatgcatgttgcacttttacactgtgtataaagatgtgtcattgtgactggtgaatggccagtagctcggcaggaagaggttaggtggaacttctggggacagagaggactctaggaagaagaaaggtggagatgccaggaaatgcagcataagcaggatgtgcagggggagaagtaacagccatgagccacgtgtcagaacgtggattaatgtaaatgggttaatttaagttaaaagaaatagaaacaaccccaagctataggccaaactttcatagttaataagaagtctcttgtgactttatttgggagctggcaagacagagaaaaaaagacatgttacaattgtgggtgagcctcaagtagctgcactgggatgtcttcacagcatggatgttggcttcctcacaaacagaggtcctctgcagttacccctccccctacttcagcctatatactttagcccctccccaagtccccaaagccatatgcatttagggcagaattgaatatttatgactggaaggattctcaagtttgggtccagtgattctcgtcataccctccttgtatgaggaatgtcagtagttgacaggccttctcctgatggactcttgactcttgtaggcagtcacggctgacctgatgacgatggcataacaacattatactgttgttttaactgacaaattttacttaatgtatcctgtgattcttccgtatcagtcagtaagcatatagttttaaaaatattctcttgtatgtatatcacatttacagccagtctgcagtgagtagacaccgtcatttggttgttacagtcacagatactgttgcactgaatggccttatccatgtcctgtagctggagtgaggagtgtctgtgggtgaattccttgaggagatattgttggctgagattacattctggtgtgtaatccccagatgagagctcccgtcttcctaccctcacttctgacacaacctcagtgtcatatccagtcatgtgtgacagtgaccatctctttatgaccctgagacacttttgtttgtttgtttgttaagtaggtttagctgtttttctgtcagatttttctgttagatttcaagtataaggggaatttggtgttgtttgtgataccacttgacaatattccagtccatttgccatctgtcttgatctgttcctgcccttgtacacaagttcttgatagttttgcagtcaggtggtttcttattttggttgtgactttctttacttccttatggttacatagggattcttttactttttctggtatttttgtgttatagttttattacatagaaatcattgatccattagaaattcatttagtgtagaatatgaggtaaggaagtatctaattctaattttccatggatttaactccccttcctatcattggtctcctttcagaattttcttgtatttttgcatatttaattttcacatgaagattacagcttctcctctcagaaatagctgtagatatttcactgggataatattaatttgtatgataaccttagaatactcacagtgaattttagactctataaaatttgtctttagatcatacagcagttggagaacatctgtctgagaatcatcgatcttgttttacagaagcgtgtcattggtaagttcagatcaaaggtaaactgagatttctttttccatttgatgaattcaaaagtacatttttgtagctctttaaacttagtgaggtacacagttttgagagaggagagcttgctttccttaaatttgaggctcagctttctgatattagctaggtatattttcattcagtggtgaactcttaatgtgtccagagaagaatttttggtttaaggaaatttaaagaatggagaatgtaatacctacatctcaagcagagctgggccgagaggtcagttggtggagggcttgcctggcaggcaggaagccctgggatttgttcccagcaccaacatacactgacatggtgactgttgcctgaattctcagcacttctcaggtggaggaaggaagatcagaaggtgactttgaggccagcctgggctatttgagatccgagtgtggaggcgtggagaagaaaaagtggcagagggagagagggagaaggaaagagggggaggatggggagaagtagggaggggtgaagtttatctgggacttgtaaagtgcacaaaactagacaaatgttttagtatgaattagcagaaaagctttgagtttccaaggtatgtactagctgctttcatgagaaaaggcagagcttagaagttagatgtctttgctcagagataagagctatgtgttttctggtgggatatttagatatggtttcctccctccccccctccctcctctttctttctttctttctttcatttttttgagactcccgagtgctgggattaaaagtgtgatccaccaccacctggcagatatggttttcttttgactgagagtagtgaatgtgtgtatgaatacagaacatttctttgggcctctttacttatagtggtataaagtattgtaaagtaaactaaagaatactgctcaaactataagctctataacttgaagaaaatgttatatcttttatagttgttggtaaaactataagtgagatagtaatacatattatctctgtatcattaagctatctagagatattactaatggtttatacattttgaatctacatgatagaagtatgctaatatagttctcctacacatttacaatataaagttatagatagaaattttattttctgttataaaatagaaatttgatttttttgttgttgtttgtttgtttttttgagtccggatctcactatatagtgctgactgtcctggaactcactctgtagaccaggctggcctccagagatccacctgcctctgcctctgcctcctgagtgctgagattaaaggtgtataccactatgcctggctgaaatttgattttttttttccctctacaagatttcaccatgctgccttggcttttcctggaacttgccacgtataccaggctagccttgagcttagagatctgctcgctgctgcctccagaatgctggaattaaaggccagtgcccctgcacatggcctaaaatagaaactttaagtttttttttctttcagtactatgagaagaccattgccttgtgttgttgagcagagggttgatcttagttaagagctgaaggcagcctctctggctgatgccaccgaggaaggtgttcaggaaatcccgtggcacatgggagggatgtgctttagtcctctatgtgatccctttaatctttctgttccctcacattctaactaaagtgtttttccttctagaattctatgaagaaatcctttccctggccttcatcttaacctgccatgccatctccccgcagatgtggcatctcctgggcattttatatgaaattttccagcaggttttctctgagtacttcacaggcatgcaatgatcatactacagtttttctttctttctagacaccctcagtactaatcagatgttttaattttactgtccaggaaatggggacagtgattataccagtgtctcagcccttaggataggcaaaggaagttttgtttgtctcctttcttatgttagtttgcaaccagagcatgtagccatttgttaattgagtaaatattttctgagcacagccatgtcctaagcactgttcttagcccagcaatccagcaggggacagcttcagccctttgctagttttcatcctggtggggggtgataacaaaggtgcactaaagccagccaatgagagccttggcagtgtgtcaggcactaaaaccagccaatgagagccttggcagtgtgtcgggcactaaagccagccaatgagagccttggctgtgtgtcaggtaccaaaaccagccaatgagagccttggcagtgtgtcaggtactaaagctaatcaatgagagccttggctgtgtgtcaggtatcaaaaccagccaatgagagccttggcagtgtgtcaggtactaaagctaatcaatgagagccttggctgtgtgtcaggtatcaaaaccagccaatgagagccttggcagtgtgtcaggtactaaagctaaccaatgagagccttggctgtgtgccaggtagtgctgagtgcagtgagagagaggaaaggtcagaagtactctgataaacagtgagcattttaaccttccacatctgcattccctttagtcataaatagagtgggtatatgtagggagacactgtaaccacgcctcctaagggctggctacagatgtgcctgaccacgcctatcaaggcgtagtcaagatgaggtcagagtgaccacggcatgggctcttaagcaacctcaagcacatggaacagtttcttccccttcggctgccccttctccctggcctccctgccttgctgcccctgagcaccctctggcttgcctttggctggtatttatctgaataaaggtatcttgaatctacaagcatttcccttcaggtatatcgtgtcctttttagtttttggctgctaagggagacagtatttgagtgctagagaagtgtggttccaatgggaatcattcatttctgctcctgttgcacgagtctcagtgagattctggatctttcccaagacatgatgcccctcctgcataattatgtgacagtagacaccaacgcgttgctgtcaaatccaaagcacttagaagtcttgttcactatgtgcaggaaggtaagtgcaccctgtcagttgtcatgtgattctccgtaatgtttgggtgtttagtttatattactttatctgaatagatttatcagcttcattttaaaagtgagtttgtgattgttgtaattttaaagtttcacagtatgtgttgtacttatgtcacttcaatatctatgtactttgaaattttttaaaaagatatatttattatgcatgcatgtatgtctgcaggccagaagaggggaccagatctcattacagatggttgtgagccaccatgtagtttctgggaattgaactcaggacctctggaagagcagccagtgctctcaacctctgagccatctctacagccccatacttactttgaaattttaagtaaatacagctatttgtctgtatccatggagacccttccaggacccctatggatatcagaccccatgaatcctcctgtctcataactaacaagtatggtctttgcgcatagccagcatacatctcaccatgaacccaacccacttttataataacatccagtacaatatagtgttatataaatagttgttaaaccgtgtgggtcagaggtagagacaagaaaaagaatctgcacacatttagtatagatccaagttttaagaaaacatctgacttatggttggtggaatctgtggacagagaacctgtgcatatggagggtcagctcgctacttttctttccattttttttttcctttcaaaaataaaaacttaatggtagctggagaggtggctcagtggctaagagcactcaggttcagttctcagctcccatatggtggctcacaaccatctgactccaggtccagggaatttggatacccttttctggcctctgtaggcaccagacatgtacttgatacacatatataaatggaagcaagacccttacacaaatacaattaaaaagaaaatttaaaaacataaacttgttataattaaagtgctgggaaaactaaccatacagtttgtcagtctgtgacagaatggtatctgtctttttacttttaattgattgtgtattggaagctacctatgtgcctagatacaggtaattttaacataagcaacataaaacaatggtaagagttacagaagcaatactttgttcagtatgtgatgatttattgttgcatttatgcagacatgattttccattatgttatcttaatcctctattggttatatcttaagaatgttttgatgactaggtcatgttacctacttcaggtaagtgtgtgtgtgtgtgtgtgtgtgtgtgtgtgtgtgtgtatgtgtatgtgtgtttgtgtatgtcgtatgtgtgttcgtgtatgtgtgtgtgtttgtgtttgtatgtgtgttttcgtgtgatattatgtgtgtgtgtgtgtgtgtttgtgtgtgtgtgcttgtttgcatgcgtgtgagtgtttgagtgtttgtgtatatgtttgcgtgtgtgtgtatgtgtgtgtgcttgtatttgtgtgtttatgtgtatgtatctttgtatatgtgtttgtgtgtttatatttgtgtttgtatgtgtttgtgtatatgtgtgtttgtgtgtatgtgtttgtatgtgtatgtttgtgtatgtgtgtgtgtttgtatttgtgtgtgtgtttgtgtgtgtgtgtttgtgtatgtgtatgtgtgtatgtgtatgtgtgtatgtgtatgtgtgtatgtttgtgtgtttgtatgtgtttgtgtgattgtgtatgtgtgtgtttatgtgtgtttgtatgtgtgtgtttgggtgtttgtatgtgtgattgtatatgtatgtgtgtgtttatgtgtatgtgtttgtatgtgtgtgagtgtattgctcaaggaggccagaagaaagtgtcagatcctctggagctggtgttacaggtagttatgagccccacagtgtgggtgctgggaaacaaattctggtcctctgccagtgttcttaactactgagacatctctcttggtccttcccatccccaatattctgtttgagacagggtttcactgtgaagctctggctggcctggaactcacttttttttaccaggctagtttagaactaacagagatccagttgcctctgcctcttatttctatggctgaaattgaaggggtttccttcctctggcattcatgctgagctaacttgtcactctaggtactgtatggagaggcaggagaggacgctgagtgcttcgccgccaaactcctggaagtcatcattcttcagtgcaaaggaaggggaattgatcaggtgatatacactaaaaaagcctcttcctggacacttacataacaaatgtccatgcctgattgatattctacttatatttgatggaaaagtaaaaaggcagccatagtatgtgcttgctggtccaaatcctgtttgaatgataggaaaaaaaatgactcagaaacattcatggcaatggtaacagtaacagaatacaaactgaagcatgtgcagtggagatcctatgtggcctgtaaagtaaaaatcatgtttgctagatcctgttcaaagaacccttgagcagagaaacaaccaaatcaaaggtcttggctgctgagcgtgctaccagttttctgcagaagagcaaggaggctgtggctggtggaggtgtgagaaaagcagtaggaaggaaggaacaggttttatagcaggagattgcgtaggaagcatcagaaaacagaaggcgttagaggagagagccgggaaagggcaagaacctaggtttgcctgcggaaccttccctgagtaaggaggccattgggcagcagagtcatgtcacccacacttacagcctacaggtggttatagatgttcataaaaggaaaatttttctagggtcaaatctaggggaaaatgggccaaacaaaagtcaactgttgtgtgactatttggagtgtgtctaggaaggtataatcatattgttttccgagttaaatatggaatggttttgctttgtaaaccccagagccatatagatggtcttgaatgggctatttagataatgcagtgacgtgtcttgagatagagggaatgtgaaaattgttgtctgatgactttatatcatcatcaacttaggagagttgtatgaagtgggaaaaggtgacagcttcagtttggagggatgtgctaagtaggaagtatttggatcagtgccttcatctgcagtgaccctgtgtgtcagtaaagagtcagtggtgtgatgcagtgagcttgttttagacttgggttccagaggattggaagctcagagctgagcactgtaggtgatggaatgttagtgtggacaccacatagcaccctcaggtatagcatgggcatgatgcttctctgcctttcctgtcagctagaggaatagggtttgtctttttagtcaagaatacttcagaggtccctgtgagttatttctgccaggagggctggtagaaatatgtcagtgctattggtggtgatcatttatttatttatttatttatttatttatttcctattgaataaaacatttctatgaatatattttcctaagtcatcagtattgctttaatttaacagaaatggataattgctatattaattttaaaacttaaggatttccttaactcttggtggctttactatgacagtaaatatttgttaaactttagttttgaaacatgtcagagtttatttatttatttatttgtttatttattttttgggtggtgctggttcttgagacagagtttctctgtgtaaccctggctgtcctaaaacttgttctgtagaccaggctggcctcaactcagagatccacctgcctctgcctcctgagtgctgggattaaaggcgtgtcccaccacagatggctcaaagttaatctttccttgtgatttttactgattcttaactaattattgcaccatggctggtgattttttttttttttttttttttttgggggggggggtttttgggggggggagttttgaggcagggtatctctgtggctttggaggctgtcctggaactagctcttgtagaccaggctggtcttgaactcagagatccgcctgtgtctgcctcccgagtgctgggattaaaggcgtgaggcaccaacacccggcagctggtatattttaatgtaaatgataccagacatgtatgatccaatccagtcctatccaatccaaggacactaaatatctaaatgagaaataatgcttgagttagcattgtagtcagaggacttgagacccacagttgttttgttttctccagcatttttgagctctcatgtgtagcagtaggattttgtttttcaagagacaaatgggtcacttcatagtcttattcattaatttccagatggatatcagttctgtctttgtcatttactttaaacatggaagtggctgagtgagcgaacaccttttcaatctcctgctggcttcagcgtggacataaaagggaatgagacttcttagactaccactgtttgcctacttagtctgttggtctctctgagtttgatgggaacataggtctttaaacgtctcctacacacagttgaaataagcaaacactttactgtcacaaagatgcatttattaaagatacagccagcatcagccttcaggaagtctcttggctgcagtgtgtgggtgactcttgcttccttcccatcctccagtgtatcccgctgtttgttcaacttgtcttggagagattgacccgtggggtcaagaccagcgagctgcgcacaatgtgtcttcaggtggcgatcgccgctctttactacaaccctgagctgctgctgcacaccctggagcaggtccagctgccacacaacccaggacctgtcacctcgcagttcataaaccagtggatgaatgacaccgattacttccttgggtatgtgcctttttggtttgatatggcatcgatgtttcaggaagtttagtttttgttttttgcttttttttttttgttttgttttttgtttttttgcttttttgttttttcaggacagggtttctctgtggctttggagactgtcctggaactcgctctgtagagcaggctggcctcaaactcacagagattcgcctgcctctgcctcccgagtgctggaattaaaggtgtgcgctaccaccacccggctggaagtttagttttcatacagtgatgtgttgagagataatctttatatcttggggactatttctcgtgtatttttatttataaatttttgaagtgtatgtatgtgggcacagttgtatcatggcatgtgtatagaggaatgtctgaggacagctgtcaggagtcagttctgttcttaaacctttacctactgagccatcactttaatccagaaaattaggaatatgttttgaagtatcacctgatggaaagatacattgtatagtgcatagtataatattagttgtttttaattttatttgttttcaagacatattgcatgtgcctaggctggccttaaataattgatcctcctgcctctaccttctaagtacaaggttttaggaattatttttattcatgtgtatgtgtgtatgcatgtttgggtaccctcaggggccagaagaagtcttggctctcccagagctggtgttgtaggtggttatgagccactcgtgggtactgggaatcaatctcaagtcctctagaagaactggtattcttaacactgagtttcttttcccctagcttttgtctttttaatttttgaagtatttaaacaaaggaaatatttcatagaaaagtatgtgaccaatcatttttcctttgtaattaaaatctccttattctgttagcagaggctgatggtagatgtgtgtaggcaaccaggtcaatatgctaggtgctgacttcttgaagtatttttggcacctggggttggtgtggatggaccatatctgccaagaaagcttgaggaccaggccaagagagcaagtctacagaattatttttcccagtgtgtaggaatcttacgctgccaagtagacatttcagctctaacaaacctcattgtgttaacgttcagatacagctcttttattaattgtaagtggtgttattgcaaaattcaaaatgctaattgtagactcctgtaagccttgtcctctgtcccgtaaccaagtcttatcttacagcccaggctggccctgaaattgctctatagtccaggtttaccttgaatttatagtacccctgcctcagtgtcttcagagatgtggttgtagggatgagacaccacacctgacctccctcacaggtctttgtgataagagttggttggttggttggttggttggttggtttgtagaatttggtttacgcagggtttcacttgctttagtttttctagagcagtggttctcaacctatgggtctcgaccgctttgactaacctctgtctccaaaaataatttccataatgattaacagttaggaaaattgcataaaatagtttatgtcttggagcacaattgaagtgagggaggatcaaaaatatgaacaaggagtcaagaccatgatggggaaacccatagaatcagctgatccaagctagtgagaggtcactgactcaggtctgacaaatggggaacctgcataagaccaaactagactcccttaatataggtggcaatggtggggctgggacaatatatgaggccactgacagtgggtccaagatctaactctaatgcacaaactgacttagtggagcccattctatatggagagatacctttcccagcctagacacagaggtgtggggggtggagaggggccttggtcctgcctcaacgagatgatgggacagacttagtagacttgggagtagactatgggaggcctcaccctctccatggagcagatgggaggaggggggagtgcaaggtgtgcgaggaaaggagggagggggaactggggttctattgtaaaaattaaattaatgaaaaaagagaaaaaaataaactagtaataacaaaaaagaaaaagaaaatagtttatggttgggggatcaccacaacatgaaggagtgtattaaagggtcacagcattaggaagagtttgtcctttgtgaccacatctgcatattttccaacatctgcagacaccacgaccggaagaggtgtatcataggactgagcatcctcttggaactgcagcaccgacctcctgctgtggacgcagtggctgcacagatcctgccttccattctcttcctgttccttggcctgaagcaggtctgtgctacccgtgaactggtaaaccgcggagatccctcaaaagcagagaaagccgacatggaggaaaatggtaaagcctgctacttatgattcactctatagtccattttgctttttaaaatcagtttatcattaatttgatattataaaaattaaattattattttttgtgcatgagtgtttgccagcatgcatgtttgtgtgccatatgtgtgcctggtccctgtacagaccagaagaaggtgttcagtctcctagaactagaattcagattgttgtgaaacaccatggtttggtctgagaaccaaaccctggtcctctgcaagagcaaccatggctcttaaccactgagctatctctccagccccagattttgctttaaaaacttaaagttatacttgtttgtgtgtgcatgtgtgtggaagtcagaggacaacttgcaggagttggttctttgctatcacatgggtcctggggattgaactcagatcttcaggcttggaggcaagtgcctaactcactgagccatctcactggcctgtgcttttttgttttttgagacaggtcttgctttgtagctcagactagttttaaattcatgattccccttgattcagtctcctgtgtcctgggaccatgtgcatgcactatcatttctgacctggagtttgatttgagcacacattttctttacattttagcctgtttgatgtcattggagtttctgttcagcctagtcctgcagcccttcagttccaaataaacacactgaggcttgtattaattagaaactgtttggccaatggctcgggcttcttattggatagctttctcttaattattaatccatttctagtaatctaagtatttccacatggtcttatcttaccagagaaagctccgaacctgttactccttcctcaaccacatggcatctccccagttgacctctctctgccttacctttcccagaattcctctggtcttgtaaccccacctatacttcctgcctggctactggccagtcaagcaataatatatacagaaggaaatctcccccatcagtttggaatcattaaacagactgactttccttggcctgcgacacatttaaactggggctgtgtcccttgataccaaaaccctcagtgacttctaagtggagctcagtcgatgtggttttgccttgagaagcataaatgtaagagaatcagatggtcttgactatgaattagcaacttaagacttaacttttttgtttatactaacaagctcagtgacagtagctaccattaactaaatgactccctagattaggtatacactgtcagtacaagattgttacacagatggatgtttttttaaagtggttcttgggtaatttgtcttcaaaaagtacaatttcaagatacttaaggtttagacaaactttatcaacaaactaggattctgtggtggtttcacatttccagattatttcataatccttgtttttcattcttttacacaattaatgggctcacagaggagatttccagtgaggaggaggaggagacaagtgttactgctcaagctatgcagtcacacaatggcagagttgaagaggaagaagaggacgactgggatgaagaagtgctggaggagacagccctcgagggcttcagcaccccactggaccttgacaacagtgtggatgagtaccagttttttacacaagctctactgagtatgtcttcacctccccccacctccattccccaaacctgaagattgttttttaacatttttaatttcttcctgttagaagttgttttgggatctgctcccatactggtatagattctctgagattttgtcttttgctttagaaaaatatccaaacatacttaaaatgcaaaaggttagcatcatgacacactcaaaaagcaatcctagactcccattgctgtagtagcagcatcaggatgggcttgccagccatctttacagatgtcatgttcagcacaagtgtcagaatggctgttttctctttcacaaatgagatgttagtggttgaggagcagagaacacagacatttcaattcctaatacatgcacccaatctccgaagagtcatacgttgtgtccacgtacccatggagagccatgtgctgtttctccttgaacttgttccagtgattctccagcctcacaggtgtcaagctctccctaagacctcatgtaacactcagatgtttacaatcctccatcccactgacccacagttttctgccacagcccattataatcacagttgttaggaaaacagatggccatgaccagagacgttacagttctgacagggcaagggcaagggcaaggaccgaggaatatatataatatatatatattctactagaaacacaagaccagacataactgaaaatactctagacacaaatgcagaaccaagactcctaagttaccgcttcgtatgctttgcattgtaggatgtaaaaccatccccctctaacagaatgttgtagtgccccccgagacagtcacagcctctcctgattcagggtcctgctattttctggttgttccaaaaaaaataaggaaccagcaaatgatttaacctcttaaaatattgtttacacataaaaagaataggataagatatgatttcccccaccttttaaaaacgtttctagagctgctaaaaaaacttgaatttacaaatagttgatagaaaatatccctctgtattgcacaagatgggaggcaggggccaatgacagacatgacgggtggggccttttttggcttcctgtgcactttggtggatgggctcggctgacagccttgcggagtagccttgcagagtggtgcttgggctcctccacctttgccactcctcttgagctgaccttccacttgggtgtcatggtggacccgggggtgggagacatacatgatgccaactcagccacagagctgcactgcctgtccaccactgtacgaactcacaatggccacttttacaattgcgggtaaagtggtccaggcatgcagtgctcaaccactgtggctgtgagcctgttaattattcccaagtccttatgggaagacacagaggacaagacccaatgaagggatgcttttctacattgacttcactgactttgtgcagagagtaacacttgtaagttataggattccttaaagccacatgtgttcaaaggccttgccaaatgagtaagagcagtagacatgaacacaagagggagatgtggatggaaaccttagagataatgccactgcaagggaatgaagagtaacactgagaaaactgggattcagatgggttgggctttctagttaagaagctgcagtacccttgaagctcagtgagtttgttatacacagttgaacagggggtggggttattatagacaactgtaaatgttgggtggcaggagttgggacgagccaggatggacattttctgcacacactgtcaatatttgcacatggatccaaggaaagctttgccgtactctgagcctcctccagagaagctttgctgctcccatggggctgaggctctggtgtccttgacatagcggtgctcatgtcaacaacacacattcaactcattcactcgttccctacaaataaaaatagagaataagccagtgaaatacttagaaaattattaacctataacttgtacttaaaaaaacccttaactaatgtctgttatttgctttatggttaaatagtagttctgtgtgttatcatttatttctactattagatgtttaatattctcaggcgcgcctactacttttgccaactaggcaatgccagcataacacaccgccattatttagttctgacacaagtataggagtgctttgaaagccagctgtggagatagggataggaaggtatgctccaggatggtcatctgtagacacagcatgcaccctgaccaccacaggagctcttgggtctcaagtgcagcctgaacatgcacaacagtttagaaggtcccctgctggggttgcatggctgtctgttgacaagcgtgggcaggagttcctggggaggatggcatagaactgagggtgactgccttgaataaaggcttctttttgcccagcacagagtggggtggatcttcaggatcccaagcaacgtgagattgttagacccaggtgcacagtgtggactctggtgggaagagtgtgtaggtagaggacgttaagagacaggcagagtttgatgtgggctgggcatggctacagataggaagggtttagagctgtgataaaaatgggagagtgaaagcatttagaaagatgttgaacttggtttcagtcttgttaagtttgaagcatttagttggaaaagtccaggaataaaggggaaggattttgcctaagggtgcagacttgggccctcagtgtagaaacagagctggtacgaagatactaggaagattccaggaggacggtaacaggtgagcccaggtgtttcccagtgtcaggcattctgggatatatatatatatatatatatctgggaaaacttgcagaaaaagaagatagaaaggacagaattagggaaatcacacatttgtaacggggacattccttgtggatcctctcggttgggtgagtgggccctcagaagtgattgtctgttgggatcgggatcagttttattatcccgtgtcttactaacttcattgagatctgatcgtgccacttacttttcctgagataataatggtcgctggctgtctcccctttccttctccaaacccccccgaaaccccatagctgtgcagaatcgggatgccgcctggtatcagctgctggtggcaccactcagtgaggaccagaagagaaagcttcaggaggtgtacacagtggcagagcatcgacggacaatggcaggtcagtcccccggtggctgccatgtgccacacttaattaaaatggctgaagagcagcccttcgtgaaaatgagcaatcccattgttttgtttttaagacaggatcttgctatgttcctgagctggcctgagtgtgtaatcctcctattttcatctgtgtgtgctagagttactagtctgtgttacttctcctgggcttgttttttctctctttttgagatgctggagtttgaactcagagcttcgtacatgctgggcaaataatgtaccagtgagctatgatcctagtccttccacctcccagtctttctctctctgtctctgtctccgtcgagattgggttttactttgtagcctggaactcattgcatagtccaagctaacttcaaactcactatcctcctgcctcaaccctcattaaggtgtatgccaccatgcctactgttttttgttgttgttgttgttttttggttttttgagacagggtttttctgtggctttggaggctgtcctggaactagctcttgtagaccagggtaatctcaaactcacagagctccgcctgcctctgcctcccgagtgctggaattaaaggcgagcaccaccaccgcccagctttttcctttcttttaaaatgagatgttctggtctagcctcaaatttataatctttggacttgtgatcttcctgcctcaaccttctgagtagctggattataggcatgtccctgtaccactaggcccagtttgatggttctttttaatcataatattgtatctctctcaacatcatttctgggtaggggttattagtgtttccccaactcacatcctcctcatgttttggagaagtaagggttgggacaagtctttctgagaaagactttgtcagcccagtatccacctaacatctacaacagatggaccaaaaagcaccctgtggatcttagaaagagcttgtattcttgaaaatgaaatgccacgttgctcaggttatcactgatgttacttggtacctaaggagatcaacttaagaggagaaggttttattttgactcttggttcagtcccttgattttgagcctctggtgaggtcgtgtctcctgggaggagtgtgaggtggaggaaatgggctggtttccagggatctcagcagcagcagcagagagaatgggactggactccaagtatcccctttaaaatcacaccctgtgtggctcaagagggggctgagcaattaagagcacttgctactcttgtagaggacccagattaggttcccagtactcacatctggcctcttggacacctgcacacatattgcatacactcggcaaatgtgtttacatgcacactgactctctctctctctctctctctctctctctctctctctctctctctctctcacacacacacacacacacacacacacacagaaacctcacttcctcccacaaggcctctcctcttcaaggctctgctacctcctgtagtgccagagtctgggaacccagtgttcatcgtgtggacttgggacatttatgacccaaaatggagcaagttctcatttatatttgttggcaacttgtcaattttcagcttttatgaaggagaaattgtttaatgttgggattttgagctcactcctgggtcattagtgggaaagattttgtggttacaaactatttcagtgggagatgggagttttagttgaggactgttcttcagtgtcactgtttggggtagggagcaatgcatgttttgtcagcatctgatgctgagtggaacctgcagcccttggctcccagcttcagaactgtttacatttcacttactttagcaaacagtttttccagggtaaacataactgcttgtcagtatggttttgttaaaggctggcattcatttagatggcaccactaatacgaggaatcgcattcatttaaagtcgtaaatccatagaaaagaggcaggcatggcaacaaggtggggaggggaattggtgtatataatcccagcacttggggtgcagaggcagggggatcaggagttcaaggccatcctcagtcacatagtgagttagctgctaatctgggctacatgagagcctgtctggaaacaaaactaaaaccagtccacttcatgaaagtctggcacttgaaggtttcttctatactctcaccttaaacatccttttatgtcttccctcccctctctgttcagtagcagggaggcttcacatttgaggacaagggcatcttctctgcctttacctttggggtcgcgcccagcaacaaccgaaaggcgcatccaaccgttcaccgaccatcatcaccgttgctgcatatttcacgggatgcgagagggccgagagagagggaagcaaggggctgtgtcatcggcatcaggcagccgtggactcgctcgcccttcccttgttccttctaacctggaatacgtatttttcaacagctactgtaatgtacgaagtttaagaaaagcagaatcattgatcagaaaggacaaagcgtctgctcggaaggacgaacgctgaggggtttagagttaggtacggcgcatgcgtctcaggtttttgccatgcagaatcagtggatttatgcggataacagtgccttctgttgtacatgaattatcagaaaaaaaatttttttggagtgcgttgcaatttttttaaatcatgaaacgtatttctagataccctgtaaccttggttatgtgtcattttattctgctttttactctgtactgactgacaggcagttagtgcaagtctcactctggtttcagaaacgaccctgccccctttggccaccctgcgcccagaggatttttcttcaaaggttggagcttaggcagtggctttggttttccaaaagtcatctgcagctttcctgagcactgttgtatattcccttttccatcacattttccctcttgaacagggtgatgtttcttttaggatcacaaatgtgttgattacattgtaacctgctaagttcagggtttacccgcttcttggcagccggcagcagagagtggttagttactgttgtcagtcactgggcttagcagctgagcaagaccgaagttcttaggaatcatgtgtttaattatgctgcaggggttgggggcatccaaatacgaaggcacattgaagttctaagcagacagtgatttctgtgtggggacttggtcggtagtaacttaccattcattctagccatgtaggacagggcccaatgcattttacaattttttttttttttctccttccagccctcttctttttgagatagagtcttgctctgtatgcaactcaggcaggcctcaaagttacagtcctcttgactcaacctctgactgccattaacacacccagctgatttttaacttcttttgaagtcagggtcttgctacccagttctggctggactggaactctctttgcagcccagtctggcctcagacttgtggcagtcttccagcatcagcctcccaggggttggagttacagccactacagaggatttccatttagtaaaaagacctaacagatctagcagcttgctttctcacagtctgaaattcctccagcctgatttaggttgtcttttattggggctcagttttttttttttttttttttttttttttttttttccannnnnnnnnncagctgggtgtataggtgagtgatgtcagtattgcagatgaattttcctcaactgttcaaatgcagaacatgaaccacagtgctttcatttggcaaaatggaaatatgtcatatatgtcatcaggacttgacgttatttctggatgtgatacacattgtttttccctgaaatatctgcagttaaaatttccatcagcaactggcagaattttctaggtgcttcctgaattaccaacccttactctttgtaaaaaatttaggttatttaattttccccccccagaagtatcttgagaagccatacatttcaaagtgagatgaccctgtatttttcatcgcccctttttttttttcagggcaccaaagctgcatgtcccccaacagttagaagggaaagattgcattgttgggggattttagatctttgaaatagtttggtttctctcatgtctcatacggtttaattataatataggtaataatgcctacacactggatcttgggcgtgggttttggagatattactttgttttgtggtgaattgtcatctgcagtattaaagggaagacatagtcctgcacgccaccacaccttgtttttgaagccagagtcattgtatgattttattaccagaagtgctaaccgggatgtgatctggttaccttgaaatgcaggaacttacatgaatgtactgtatatgtataataaaatgtgggctaattcccagaaatggaactgtgctgtatggaatgttttctgggatgttgaagtgataactcattggcatgtttttccgacttccaggaatctgaacacaagagggctattggtattgagaggacagcaggagatgtcagagccagcaggtctcatcatgaacagtgagagcaggggaatacttctgcaggccatggtagtgtatcctggtagacaaatgataaagaggatgagacagggggctcactggtttgaggccagcctacactatacttttagagcagggcacggtgacacattcatgtaattccagcacttgctagcaggcaggaggatcagttcaaggccatcctcatcatcaagctgagttagaggccagcctgggggggtgtatgactgtctcaaaattaaatgtataagaatttaaaatactaaaaagtgaattgaatagcatttcagaaaaggattatacactgtagtcacatgaaatttatcctaagggatttgagaatgttttgacacatgaattaacacacctgtgagacaaaaccaccatcatttcaataaacatggtaaaagtagttgataaaatttaacatcctccaataataaaaacttgaaaaagtttagcaagaatttgcctcaacttagtttcatatgtagtaaattcaggtagcgccatattaaatgggaaaaattgaaagcatttcttctgagaactaactttggctgtttttattgttccagaaggcttagcctgagaaattaggcaagagaaagaaatgggggcacccaaatcagaaagaggacctttttttaaaaaaaaatatcttttaaactttctttttatttattctttgtgactttcacatcttgcatctcaatcctacccatttcctgccctctgcctttgcacccccctcccccccataaaatagaataacatttaagagaaagaaaaagaaaaatctcatcatggaagctgtcgtgtggcacagcgagtcccacagtaaaccgttttatccatgtatctttatgtgcaagtgttcattgcaaagtgttattggtcaggttctaatacactattgatgctggtccctcacatggacgactcctggctatcctgttgttgccctgtgtcatggaggtcctgcagctttgggtctgcaggattggccccttcaggtgctccagcagatcacagatggggtgggccaactcatagccctggttctgggtctaaataattgctggcttggtcagcatgctggctcttcccccatcctcacctccaggttgagttctccagcattgccctggctagttcatcccttggagcaatgagcaaggggaggagccagttctcttgctttcatgccctcagggttggttcttcccacacctataccatcagggcagctctactgtgttgcccaggtgaggtgtaggggccattctctgtagtgctgcaggtggtgaggggcaggattaactctcctgatcttataacctcagggccagctctcccacctgccacaggcagtgagggggaggagggcatctcttccctgcccgcgccatcacatggcagatgaggggtgggatcgcccatgctcatgttctcacccgaacctctgtcaatagggtcagctttactgtgctgcccgggagaggtgttgggtctacagaaagaggactctatttctgtttgcaaatagcatgaatttaaatttttatttttaaattttacagtttttttctgacaatttttttaaatgtagtatattctggttatgcctttccccctcctccaattcctccaagatcctccccatcacatgtgcatatttgggtcctgtcataaaggttctagaatcaaattcggttcttaaggcttgacagcaatcaccttacctagtgagctatcttgggggcctagcatgatcttacacaaagaaaaatctaaagacacagctaaaaacctgttaggactgaaaagaagttcagttaagttgcagaatgtaagattgacttatcaaattagcaagcatatctctacatgagtaataaacaagtagaaaaatcaagagaataataagagttacaaaaataaatataaccccaaaacctataataaaattgacaagggaaacaaactataatgaagataaactattgatgaaagaaactgaagacactgaagggaaaggtactccatgttcacagattggaagattattatgtgtgtgtatgtgcatgtacacatgtgtgtatgcgtgtggaagccagaggctaacattgtatatctttaattgattcctactttattttttgagacattttctcttgctaaatctacagttcatcaattggctagattggctggccagtgagctctgaggatccgcttgtttccgccctagttaccaccaatactagggttacagatatgtactgtctactgaatgatgttccttgattccaagatggcttctatgagtccacaatgaccctcatgacttcaagattgcccctgatgcaagatggatcccagtggttctaaaatggatcccatgccttttaagattgctgccagtgatcttgtccagttgtcttctatatctcttctgtaatgatatggcaaacaggagaccaagaacccaaaattatatgatggataaagaaagcattttcaacaaatggtgctggcataactggatgtcaacatgaagaggaatgcaaatagatccattatctgtctccatgcccaaaactcaagtccaaaaggatcaaagacctcaacataaatccagttacacaacctgatggaagagaaagtgggaagtagccttgaacacagaggcataggagaccactttctaaatataactccagtagcacagacactgaatgggaccccctgaaacccagaagcttctataaggcaaagggcatgtttaataagacaaaacagcagcctacagaatgggaaattatcttcaccaaccccacatctgacagagggctgatctccaaaatctataaagaactcgagaaactagacatcaaaataccaaataatccaattaaaaatcggggtacaagatctaaacataatcctcaacagaagaatctcaaatggccgaaagacattcaaggattgctcaacacccttagccatcagggaaatgcaaatcaaaacgactctgagattccatcttatacctgtcagaatggctaatatcaaaaacagctcatgctgcagaggatgtggagtaaggggaacactccttcactgctggtgggagtgcaaacttgtatagccactttggaaatctgtttggtagtttctcagaaaactgggaatcagtctacctcaagacctagcaataccattcttgggcaaataccataccacaagaatacttgctcaatcatgttcatagcagcattatctatagtagtcagaacctggaaacaatctagatgcccctcaactgaagaatggataaagaaaatgtggtacatttatacaacggagtattactcagaggtaaaaaacaataacatcataaaatttgcaggcaaatggatggaactagaaaaaaaatcatcctgagtgaggtaacacagaccttgagagacacattgtgtactcacttacaagtggatattagatgtaaagcaaagataatcaggctataatcctcagccctagagaagccaggtactaacaagaatcctaagagggaggaatgaaccacactgggaaggggaaatatatgagatttcctgggtaaactggggatggggctaaaggggaggggatggctgggttgggggaggtacagagaggcagagcaatgaaagagtatcttaatagagggagccattatggggttagggaaaaacctgtgtcagggaaatccccaggaaaccacaaagatgaccccagttaagactcttatcagcagtggagacggtgcctgaactgatctgtaatcagattggtgataccttaattgttatcataaaaccttcacccagtaactgatggaagcagattcagagatccacagctaagtactgggcagagctcgagtccaatggaagagagggaggaaggactatatgagcaaggggggtcaagatcatgatgggggaaatccagagacagctgacctgagcttgtgggagctcagggactctagattgatttatagctagggagcctgcagtagaccaacctaggcccttgcatgtgggcgacagttgtgtagttggtctgtttgtggggttcctagcagtgggactaggatctgtccctagtacatgagctggctttttggagtccattccctatggtgggatacctggctcagccttgatgcatggggggaagagcttggtcctgtctcaacttgatatgccatgctttgttgactcccatgggaggccttaccctttctgaggagggggggcatagaaaaaaggtggtgggagagaatgggaggagaagagtaaggggaaactggctagtatgtaaaatatttaataataagaaagaattttgatgacatccaattaatcaattgacttttaaaagcttatgataagtttttttcccaaaaggacactattgtgggctggcagctttgcttcccactgaggccctattccccaatatttcaggatgtgatctcattgagatgggaattcacagagggtcaagtttgaaattaggttatgggaatacattctaatcctaatggctgtatcctacataaaagggaaatttgagggcaaatagaaagaatgctaagtaaacaaatgtagagattggaggggtgtcgtatctttacaggccacaaatttccaaattgctgtcagagttctagaagaggagagatgcatggacccagaagggcctaccagcctgtatctagatctggaagctttacctccagaagcacaaaatgaattactgttagaactttcatttggcgtatacatagcgtactcagtaaacagcttgccccacaagcatgaggacttgggttcaatccccagaacccatgtggaagagatgggtttgtcatgtgcttataatctcaatgctgaggaggcagaggcaggtggatccctgaggttccagggccagccagcctaccctcatcagtgaactccaggccaagatgagatgtcgtctcaaaggaggtggattttatccctgaaaatgacacccggtgatagattacaaataaacccaaaaaaacaaataccagcacacagctgctcttgaatgaacatgcacacccacacggactaaataaaagattcactttgtgagtctttattaccacagtcctagcaatggtcactaagtcatgaaaatgtcttttctttttttaaagaaatttggagcaatcttatgaaagagttcttgagttcagaatatttcagtatgtcctaaagaagccagaatttgctggtagtgctaatgtttttattggaatgaagatcccgccttgtctccggtaagcagcgtgatttcatctttgaaggttcagaagtacagttttggtggcaggaagctgcagtttgctcagctatcattctgttcctgttgaggaaatgctttacttcttcattggtagatagaccccaaacagaaggttttggaatgaaggggggagtagtgaactgtgcttgtagtaataagtggaggcaagaagtcttgcattagatttcagcagaggctgagctgtgtctcttccgtgtttaatgtcatcttcagctctactggtctgccggaaaccacagcggctttggaaattcaaatagacaaggggactcatggtatcctcagtctcgtcacgatagataggaacccctaagatggaatctgatactaagggaatctgtataatcacttctgtgattctcatgcattcttacgacagtcttgaggataagtccctgctgggatgctaactctgaattacaagcattctagccaggtgtgacagcttctgtgttagctcttgggagccagaggcaagagaattgagaagagtttgaggccaacctgggatagatgacagaaagtcatgataagatgctagggaaagagaaacagtttttaatataccatcttgcagaaagggatgacaacctagaggatggttttaaagtccctgatcacgagaaattcctatctattcctcccacccctccccccccctttttttttaaaatttggtattgtggtaaaatacacataaagacaggggctggagaggtggctcagtgtggttaagagcactggctactcttccagtggatccagggtttgatttccagcagtcgcatggcagctcacaaccatctgttaacgccagttccgggagatctgacaccctctttgtattagttagggttctctaaagaaacagaattggtaggatgaattgtgtatattaaaaggggatttattagagaggcttacaggctgtggtatggctagtccaacggtgggctgtctcccaatgaaaaggctaagaatctggtcactgttcagtccaaaggccaggtatctcagctggtcttcagtctgtgttggaatcctgaagaagtaggttctaacaccagcaaaggaatgccccagcagtagggaagaacagcaagaatgagggtaaacaggtaaaatgcagaagcttcctccttctgtgtccttttatgtaagctgccaccagaaggtgtggtccagatttaaggcgggtcttcctgatcactgtgaatggtcaggacccttcaaatgaccaaatcaagagtaatctctcacaggtgtgtccacctgattccatatgtggtcaacttgataaccaagatcagccatccccacaggtaccagttatgcatatggtacactgatatacatgcaggccaaacacatacaaccccccttcctcccccatacccacacttggtgtgaaccatcctattcctaagtgccccctcttacatttaaatctatgttaaaatcttttcacaataaaattgcttttaaaattacaatttaccatttgtgatggtttgaatgagatgcctcccattaccgtatgcctgtgtgtatgcacaggtgtgtgtgcgtgcatgagcaggcacacacacacacttgtaggtgatgacagtgagcatggctccaggaaactcacagagatcatttctgcttttaaataaacagatgactgaagatgttagagccagactgtgagccacagagctgaaaggatttatgtttgcagcacacagtataaattctgaattgggctgatggctaggggttcttactggctagctctctgttaattattaaaccataactactaatctatgcatttctacatagccttatcttaccagagaatgcctggtgtgtcctatcttcccagactctacatggcatctccaggtggcctctcttctccttcctctcagtagccctgcctatacttcctgtctggccaatagggttttattcatcaaccaataagagaaacatatatacagaaggacatcccccatcagcttctggttctcttttttgagaaaaacataattttgcctgatggttaagacgaccccaggtagcaactattccgaaagaacaacactgttgatatttttgctgtgtaatatctcccatctgaccaagtggccagaactacagtttcctgtctctgtttaaattgttcagagtgtaacctgggactgggacccaaaagaaatttaacgatgacagcatatgtaaattgcataagcctgaggtgtaacagtgctacagatcccacttaactgtggaacatggatctagaattaaagagcagtgtgatggtttccaagggacggtctgtgagggcaagatgttcgccaaaaggcacaaattttcacttacccaggatgaatagttctggagactttagcatggtggctctagttaacatactgcattcttgaaactaagagtagatctccagtattctcactacaaaaaccagaacaaataaaaacactggtagttattggaggtaactgacatgttaatataggttggttaagccagtcacttgacaatgtaataaagacctcatgcaacacacattaaatattacgtgtgtgtgtgtgtgtgtgtgtgtgtgtgtgagattatgggggcactcaagttcgtgaaaattatgggtaaggcattttgtatcttccttactgtgcaacatttccacagcccaatgccggtagcacactaaaatctctcttcttgaaatggtcaacctgcattcccccacccgaaaccctgctctgagcaggacacaggtccccaatggatccatctgagtggcatcactgtccccactgtgcactccatccagtattgttacttttagcttatgtgacaggtgttgatgtaccttcctccaggaagtgctgaaccgtctaggtcagagaatgggcacaaataattatgctatggttagtctggcttgcaaggtgaatcaacattttaaaatcagttgcaaactttaacattttgcatggaactagctttctgatgccttttgaaaagctggaaaattctgcattccaggactcaacagttgtgagctgggctgactatgttagatgaagcaatggtctttagctcagttaattagcagcctggaggcactcacacgtgaagctggggaactcaccaggctttgttctgaaccacataacagcaaagtaagcttgtcttcttgcttataaacggctatgcagttcagagcacctatctgctccagcctaaaaggtcacaggacagcattcaatctcttctcattcaaacttggaccctcacacattaagcagagaacttcacccaccactaacccatccttggttatgactctgtgggtttcaagagtgacctatgctcatattccttttaatcatagtctcaggagtgtgctaacaaacctgctgattaattcacttttaagtggttttccttttctttcctcttttttttggggggtggggtggggtagggttttctatgaattattttctcattgctgcaaacaaatacctggcaagaagctcttaatggagggagggtgtgttctggctcggggtttgagcagacatagtttattatgttgaggaaggcaaagtggctggggctccctgacagcaggatcatgaggttgagtcctcataggttggtagaacaggaagtggacaatgtcagtgctcacccttttctctcttttttccgtgaaggaccatatcctatggaatgatgccacccatgttaggttgggtcttccttcctcagttaaatctctctggaattaccctcacaaacacgcccagagatgtgtctcctaggtgattccaaatccagtcaagttggcaacgattcgccgtggcaagattgaacccagggcctttctcatgattaacttgctttttagaggaactttcgagtttatttaatgaagccttctgggtagctttgatttaggtgggttcctttaatttcatccatactgctttggtctgtgttttcatccactctgaggaaggacagtgtgcccccatgagaggcccaactagggccagaaaaagtcaaagatccatgttgcaagtcacctgagaccacttggcctctgttacccagaccagtgtgaaaccaggcctcttggtaagggctactttaattattattccattatgctctatagaaaaggaacatggacacagtagcccataccagtatccaccagtcaggcagtctgtgcaaacacaatagtggtgtaagcctgtagatttcacaccacacattttataagaagatcctctgtcagatttgtttttacttttacattgtggtggtggtggtggggggaagggaactagtaattgttaaactactgaggttccatcttggcttagcacttccactacttccaaggtcaagtccaagccatcgaggccagcataattccccagcaatgttttcttcaatatgctctgagaatttttcattaccactgacagcttgctactatggagtattcaaccagaaaaatgaaaagggaatgaagagtgaaaattaaattaacacgttcccagagataacacctttagctcatgaataaagaggtgttagaaaattcacattaggtgttgtcaagatctaaatgtcaggataccttctgcatctgttaccaccgataccacccccttcaaaacagagcttaaaaataacctgaaaagacctgggttttcaggagcacagtttataccaaacactgagattggaattttttcttcctgaaaagatacattaataccacaccttcaagaagtaaaatatggcagaaagaagtagtgaagctatcaagtttaattttctttccccagatatgtaaaaaaaaattcttttttgagacagggtccttctatgaatgtagctctggctgtcctggaagttacatcaacgaggctggatttgaactcacatagatctacttgccgctgcctctttgaatgatgggattaaaggtgaggcacacatcatatgttttaaactaaaatgttttgttccacttatggaaatctgggatagttttcaacttttgggacccaaaaaagctaacaaacttttcaaagtaaccatgcatttttaggaataaataatctttccaatggcttcaatttcaagaatgcacataaaattgtggggcaggcacaagtgttgccggcagctgacctttctctcttctcactgatgtaacctgagtgagtaaagtgctacttttaggatctatgaaggtgccaggtgtatggctgaggcaggaggattgctatgagtttaagaacagtgtgttagtttatgttgttgtgataaaatatcacgacgaaaagaaacttaaggaagagttaattttggtttacagttccaaagggggcaagcatagcataggggcatgggcaggggcaggggcaggggcagggagtagcagagtgatgacatttcatccctgtacaggaagctgggagagggagagagagagagagagagagagagagagagagagagaaagagacagagatacacagagacacagagaaagagagagggagagagggaaggagagaaaaaagaaagacgagagagagacagagggagggacagagacagagagagaaagagacagatacagagagagacagacagagacacagagaaagagggagggaggaaaggagagaaaaaggacaagagagagacagagggagggacagagagacagagagatggagacagagagggagggagagagagacaagaaacagagacagaaagggagggaagggctagagagagggagagagacagagacagagaggaaggggagagagagagggagggtgagaatgaatgaatgaatgaatgagtaggaaatgggttgaagctatattcaaaacctatttcctctagcaaggctttctctgaaagcttcctcaaacagtatcaccagctgtgcctagagatggggtattgttataggcctgaccatgtgttgatcaggggaaatccggacttttggagtttgggttaggaaagcagtggactgcactgagcatggcataataggccatgccaacaagcatggaagacagtggtgctgagagtgatttgaacagtgggggttggctcaagaggtttcagaggagaagaattttttttttttttttaataatttattttatttgcattggtgctttgcctgcatgtatgtctgcttgagggtatcagatctttggagttacagacagttgttagctgctatgtgggtgctgggagttgaacccgggtcctctagaagaagtcggtgctcttaacaactgagccatctctccagcccccagaggagaagaattttaatatgttgacttgagatcatttttgtgatattttggtgaagaaagtggctgctttttgcccttgtctgaagagtctgcatgaggctaaagtgaagagatttggattaaaacaacatattgcagactctattgtgtggttattattggtcactcatattgaaagacccctgaagaggtactttcgtagaaggagacccgcacccattatgtgggtcattactacattcaatgggggtcagggattgtagcctccaaaggcagtggcactattagggtgtgtggctctgttggagtagttgtgaccttgttggaggaaatgtgtcactgtgagaatgggctttgaggtctcctatactcccgtgactcccagacaacttcttgttgtctgtctcaagtcaaaatgtaggaatctcagctctatcaccagcaccatgtctgcctgcacaacacaatgtcacatcatgaagatagtggactaaacctctgaaaatgtaagataccccaattaattttttctttataatagttgttgtggtcatcatgtctcttcatagcaatagaaaccctaactaagacagaagttggtaccaggagtggggtagtactgtgatagactgaaccatgtttctgtttggaataatatggattttgggagtttggtttaggaaagcagtggaatgcttcatgtgctgcttaatggacaatactagtaggagaatggaagaccatggtgctgagtgtgatttgaactgtggggagttgactcaagaggtttcagaaaagaattttaatgtgttgcctagagattattctttttatattttggtgaagaatgaggctgcattttggctttgtttgaagagtctgcctgaagctaaaatgaatagattaggattaataccatttgtagaagaaatccccaaacaacctcttatagactctgtcatgtagttattaggggcaaatctaggaagatttataatgaaaaggagcaagaaaatgtaaaatttgaaaaaaggaagatcaggaagtagaatggagctaaatcctgtgttcaaggagatgaacagattaagaaatggaataaagggagtggtgacctcagggctaatatcccacccagttaaagtttccatcttgtggaaaggaatgaaagaaagcctagagctgtgtgtggtggtgcatacctttttttttttgagacaggtttctctgtggctttggaggctgtcctggaactcgctcttgtagacctggctggtctcgaactcaccgagatctgcctgcctctgtctcccgagtgctgggattaagggcgtgtgccaccaacacccggctggtggtgcatacctttaatcccatcacttcagaggcagaggcaggtggatcatgagtttgaggccagcctggtctaaggagttcaaggacaacaaagcttactcagtgaaggtaaccactgaaaccaaaagctggtgaagatgtaattgaacaaggggccatgttccagccccagcaagcagcagaacttggcagctttggccatgtggttttggagttaaggacagaagaaacaggttatgaaatttgccttcatgactaaggaaagccactgaggccaggcatgagtcaggggtgtccctgaatggagacttagaggggccatttcctgaagctgtgaagttgaagcctgaattgccctggagaccccaagatgttggagatgccagagctgtgggaaagctgctgaggaagctgctaagagggagtggaaccagcccgagagaaagaaggtgcagtcaacaaagttgaaaggggttagagatctgaagagcgttttttttgtttgtttgtttgtttttttacttaaacagtctttaatggaagctgtgtatgaggggctcctactcctgcatcttctcaattgtttcttccttgtatttgcccttctcctttcctacttgtcgagacttggctttcctttccaggatcttctttcggtctttgtccagctttagcctggtgataaccaccttgctggggtggatgcccacatggaccgttgtgccattagctttttctcgctgcactcgttcaatgtaggtgacgtatttcttcctgtacacctggaccactttgccaatctgctgacctttgtagtgtcctcggacaaccgaacttcatcatcctttcgaatgggcatagatcaaacactgtacttctgtctcagctctttggaaagaggggaagacatgatcttcctccggatgtgagaaggtgcattgaaatgccatttgcagttcttgcttcggtcagaagtcaccaagggattgaacttcattttggcggctgcgatccaacaatggccgcctgaagagcgttttgacgttagacctggagatacagagtttggagtttgcccagctggtttttggtcttgctttggtccactatttcctcagtatgctcccttccctgtgttttggaatggtagtgtatatcctgtatcattaaatgttgaaagtatataatctgctttttgacttagattttataagggattacacttaagagattgcatgattttagaagagactttgaactttagacgcttaaataagtttgagattgttatagactttgaggacttttgaagttgggctgaatgcatttttgcattttgatatagctacaagcttttgggggccagggagtgagtgtaatgtggtggtttgaaagaaagtggccccaaagggagtggtgttattaggaggtgtggcttttttggagtaggtatggccttgttggaggtaagtgtgtcactatgaaggtgggctttgaggtctcatatatgctcaggccacacccagtgtctcagaccacttcttattgcccttgagtcaagatgtaggaatctcagctccttctctagcaccatgtctgcctgcactctgctatgttgcaccataaagataatggacaaagtccctgaaattgtaagctccttaattaaatgctctcttttataagggttgctgtggtcatggtgtctctttacagcaatagaaactctaactaagacacccttttttttgtatttttatatttgtattctttttccctttttaaaatttaaattagacacaagcttgttttacatgtcaatcccagttccctctccctcccctcctcccctcctctccccaactccctatcccattccctttctgctacccagggaaggtgaggccttctatgggaggtcttcaaagtctgtcatgtcatttggagcagagcctaggccctcccccatgtatgtagactgagagagtatactctatgtggaatgggctcccaaagtccattcgtatactagggataaatactgatccactactagaggtccatagactgcccaggcctcctaactgacaaccacattcagggggtctggttcagtcctatgctgttttcccagctatcagtctggggtccatgagctccacctcgttcaggtcagctgtttctgtgggttttccagcctggtcttgacccctttgctcatcacttcttccctctctgcaactggattccagagttcagctcagtgtttagctgtgggtgtctgcctctgcttccatcagctactggatgaggactctaggatggcatataagatagtcatcaatctcattatcagagaagggaatttaaggaagcctctcctattgcttagattcttagtaggtgtcatccttatagatctctggacatttccctagtgccagatttatctttaaacatataatggctccctctattatgtcatctcttttctttttttctttttcttttttggttttttgagacagggtttctctgtgtagcattggagcctatcctggcactcgctctggagaccaggctggcctcgaactcacagagatctgcctgcctctgcctcctgagtgctgggattaaaggcgtgcactttctttctccctcatgtccttctctcccctcctcttctcctcttctctttctcctaactccctctcccctcccccatgctcccaatttgctcaggagatcttcttctccaggggaccatgtatgtctccttgttacctagcttctctggaggtatggattgtaggctggtaatcctttgctctannnnnnnnnnnnnnnnnnnnnnnnnnnnnnnnnnnnnnnnnnnnnnnnnttttttttctgagtagtactccattgtgtaaatgtaccacattttctctatccattcttcagttgaggggcatctaggttgcttccaggttctggctattacaaataatgctgctatgaacatggttgaacagatgtccttgttatatgaatgtgcttctttggggtgtatgcctaagagtggaattgctggatcttgaggtagactaattcccattttcctgaggaagtaccatcctgaattccaaagtggccacacaagttctcacccccaccagcaatggagaagcgttcccctttctccacatcctctccagcacaaactgtcattggtgtttttgatttagccattctgacaggtgtaagatggtatctcagagttgttttgatttgtatttccctgatgacttaaggatgttgagtaatttccaaggctgaaattatgtctctcagaacatgacatgattggactcaggtgttattccaaacttgctaaggagctggattttcaatatttcttattctcacttcaaatggaactctgtaagtctctatttcaagtctcatagagtaacttgctcttataggtcagcaaatttagatactcagagtccttcataaacaccaaagtctggaactatgcctctaaggaaacttgaaaggagctagagagatggcttggtggttaagaccacttgctgctcttctagaggactcaggtttgatttccagaacccacacagtggcccacactgtctgtaactccagttcaggggatctggtgccctcttctgatctatgtgggcaccagatactcacttgatacacagacacatatgtagataaaatgactatataaacagaaaataaatgaataattaaacctcacaaaaccttgagtgatgtcatcttcctggcccaaagagggagggacctctttgaatatttggttttacatgggcatattaaaagttgccatgtgtttaagtgtgagatttctgaacttcgcatgccaggataaccttgctttgaaagggagagttgtttggggattttctttcaattcttagatttattcaattattttatatgagactgttttgcctgtgtaagactgtatgtctgtgcataaggtgcatgcatggtgcctaagaggtcagaagaaggagttagattccccagaactggagttaacagatgatttcgaaccaccatgtgggagcagggaacccaacctgagtcctctgcaaaagcaacaggtgctcttaactgccgaacaatcttcctcatcctgttttgggattttaaattccagaagttttttttttttttttttttttttttttttttttttttttttnnnnnnnnnntgaagctctggctgtcctggaactctctgtgtggaccaggctggcctttaactcacatagatccacctccctctgcctcatgaggtacatgctaccacacctggtcaatcctagtgttcttgaagaaaggcttctgtagttccttggttcagtgactctcaggcgatgactagtgtctctaatggaggatcctaaggcttttttttttcccttttagatattggatttccctgaagcacttaaaaagaattccacaaccaggttacatctaatacacctttagtgttcaaggcaagttccaggtctcaagatgtccaaaataaccctatattatcttttttcatagctaaattcggacgccacttcaagtggctggacaactttcccttacaggggtgttgtgtacatgtatgcacgaatatgtgtgtgtctttgtgtgtgtgtacttatgtgtacaagtatgtgcacatgtatgtggagggtaacctggattgtctttccttagacatcataatcatacctgtttttttttttttttttttaagacaagtctcttatgggcctggaacttgccaactaggctagactgattggctagcaagccccaaggatgaacctatttctgcttccctagggttgggattacaactgatgtcactaagtctggcttttttaaaaccatggatcctggggtttgaactcagttcccccatgcttgcaaatcaaacactttactatcttcccagccccacaagatgctttgaaaaagaatttaagaaacactgtctttagtaggaggatttaagacccactgattacagaatcaaatggatctcacaaaccacttggtggcagtcagctctcggtatctgcagcaaagatctgaactggaagacttttttttttttttttttttttttttttcttttttctttttaagaggcctgttttcttttgtggctccattgatcatcctgaataaacattgttcagagataaggaagtttcgcccctgacacactcagaatgtcacaatcgagtgcaaaaatatcatcggttctatagaagcgtcttttgactttctttaaaaatttttttcatcaaatgcttttctcaccttctgtttatttaaaggacccgtgatatacctacacatacatttatttatttagtgtgtgtgcatttgtgatggagggaagtgtagctggaggtcagaggacaactggcaacactcagttctcttcacgaaccatgtggttcctgggggtggaattcaggttgtcagccctggccgcaggtgtctttccccactgacccatcttgctggtccctaaaatataatttcatactaattgtaagtggctagattaggtactggaattatttcagccgaaaatttgactttggtggctaagaatccaataggctcattatgttgtaagtgaatctagtgctaacgacagccctggtgacagtgacagttactggttatttacaacatgcaagtccagcccagagattgtcaccaactggctataaaagctgaattcggccacacaaactccctgagctgtgatctctcatttgaaaaggattagaccaggcagatatatcatagggtctttctttctttaacaaaactataaatgtaaactaataacttttctaagtatatccctgggaaataacccagacatgtaacttctagtgcaggggtttctttagaacaggtgtggtcgatcagacaccatgtatcagaattctctgaaggttgtatacctgtaccacgtgttggtggtgaaaggaactttagtctgttctgaaatcagaaaggaagccatcatgtcttctttgtcttgagaatcaagcttcaggccattgctgggaccctgtgatgcagcctggaggctcattttactgctgagtatgtcactcttccctatggaccatgcctccatgtaaggagacgcaaacaaggagatgacctcatgcagcggctggcggtaatttcactctcaaccctgccatcaattgctttgaattctctccaacttgctaagtctttgaggcagttgcttgttgtgcatgggtggccttcagaggatgccagggagttttgtgtgactacacttgggaatgttcgtcccaagctacaagcagctaattactcaggaggaagagacaattcattcagtggtgtaactgttagagtgcccatgcatctgcaaatctctgacccatgacctacgaaccactctaattaaacctgctgagtcacaagcacatatacacaaagacatgaaagtagaaggcagaatagttgagaagaataattatcattgtggcaggaggacaagggacaataatggggtaaatatgatcgaaatgcattgtatatgtgtggaaatgtaataacatcattaaacattattttaaaagattatgtgtattaatgtcttgcctgcatgtatctgtgtgcgctacgtgcatacctggtacctgtagaggtcataggggtgttggatgccccagaactaaaggtacagatggttgtgagctaccatgtggatgctgagtgagacctctgtaagagtatccagaggcacctctctaactccactatgttcaatttatataagttcacacaacattaataatgtctgttaatcttgataccagagcatcctatgattgggtggaaagtgttgaaaatgacactcctgcacattgacagaaaatctgtgactaaaatgagccttcatggttactacaatccaagcctttgcatttcctccaaatccagaagccgaaaccccctgggggagggactaggaggtcagacccttaagtgattaggtcttcaggaaagggatttcatgaatgagattagcatccttataaaagaagttcaggagagtttgttttccctttctacactgtgaagacttaacaagaaagagtcatctataaacaagaaagcactggaactgaatctgtcttggcatcggtcttcccacactttagagctatgagaaataaagttgtttataatttacttttatattttgacagtaatctgaatcaactaagaaaatggtcaaaagactaacactgggaacaaggcaaggacatttatattttctactgcaacttaatactgcactggaggtcccagacagtatgataggacaagaaaaaaaacaattaaagctatgcacactgacaagcagaagtgaagttttccttatccacagatggcttcaaaatatacaaagaatcctgaacattgtataaaaaatataataaagcaagactcaactgcaaatagccaatttaactaggtttccaagtgaaaggtcaatataccatgatcattaatggaccataaagataaagtgtaacacttcaaaaggtttgcaagaaaacacactaaaaccttccctgtctgggattaggtgaagaattcttacaggtgacatcaaagatgcaagaagaaagtgaaagttatggaaaactggatttcacagaaatttaaattttcatgtttaaaggtcctcatcaagaaatcgaaaagacagcccacaaaatatttgtttcaggagaaaatgaccacaaatcaggcatttgacaaaagccttacctccaaaatccaggaaggatttttccaatgcaacagagaaagataaataaaccagttaagcggggaacaaaagatgtgagtgagaacttaaggagaaaagaaacatggaggtcaaatgatcctgggcagacgcccattagtcaaattccacgagagccacagtgacaccaaggcccgttaggccagccatagtgaaatgatggacaacgagccgtacagttcgtgtccgttagcaatggaacattatttggtcagtcaggaatgaagtactgacatgtagatgaacctagaaattctgctgagcagaggaaaccaaacacacactgtatatatttcagtatacaaaatgttcagaacagaccaaaccatggggacagaaggggggattactgggaatggctataatccagtgcaagtgactttatgcaacaagtacccatcacaaatatggaaccagcatacagatattgcttgacaaatggtatgtttgcaatactgagtgcttcagggtcagttagggtcagttggtaaataatttaatttcctggaaaaatctgttgatgtgggataatgctcttgtacacagtaaagatttgtcacgtgtattgatttaataaaatgcttattggccagtagccaggcaggaagtataggtggggctgccagaccaggagaattctgggaggaggaaggcatgcagaggaagcaagatgagaatgccttactgagaaaaggtaccaaaccatgtgactaaaaatagataagaattatggtttaatttaagttgtaagagcttggtagtaataagcctgggcaataggccaaacagtttataattaatataagcctctgtgtttatttgggactaaaggacttcaggactgggtgggacagaaacttccatccattctgttgaagatttctgtaaaccatcacttaaacacatttcccacgtaatgcttttctgtgccgtccaacaaatacagagcaaagctgttagggatagcattcaacatgctcgaagagggacagtcagacatcaggcaggcatagatagatgcacaacagatagactacagacaagctacagacagatggaagacacagggagagaagtcgagaattcaaacccaagaagctgtgatgaactttccctaacgctccatgacacgatgcattttggtgcctctgaaggtatctttaacattttaaccaatgtattttggtgcctcatgtgaggaatctctaatacatttaatagatgcatatcaagacaccttagagaggtcttaaaaattaaagggaccctgctatctgtgacagtgtcacttaaggaagttggagcccacataaatggactacgctgaagcttgaaaacggtaaagttcccattacttaaaaacctgatgagaacttgttagaatctaagatgcttctccattaggaaagaggcatctgggtgagctggatgtgtactcaccccagtgacctgcacagagctatcttcttttgaagagactgagagactaggtacttttctggtcaccatggagatcaagccagaggccagcttcctccatcctggtccatggatgaacctgctgctgagcagagatttacagaggaaccatttgaaactatgacatctgcacagccctgaaacctggcaagctacaagctggactccagttctgttcaataaatgtagcacgagttctaataggtctccataataaaaacaccggagtcagatatgggggtgaaagcgtaaaggtcagagaagcagagcaccagagctcttacctctatgaaatcctcagactgagtagagagtaaatcagggagcacatggttgaggcacatttccaaggagcctctgacaagccccatggagattgaccatgtctcattcacaggctgtgatgaccccagttaccgatatgattgcttctgacaactcgacactagattctgcatctcctgcacatttgcgaccctaatcagccttgcttagcaaagttttaaagatgccttttaaagcttggagtggcagagcacccctgtaaggctagggatgagaaagagtagcctgggttacatggcagaatcccatcacaaacaacacccccaactaaaccaaaccaaccaaccaaacaggccacctaactagagcaactgacccagttgtgagtagggggaacgatcatctctacagcactcacatgtctttccctgtgactcattcattagaaacaggaggatgagaggcagtaagaaccttttctcacctctccacctctctccacgtctctccttgaatcaggtcacaaaaccaggaataggactctctgatatcccctgaagactttcctgtgatggatatcctgcctacatgtggaggaaggaggaagctgtgtgagaaaaatcaaagcttcgggccttactaggcattcctactcttgttatcattaaatcatcattttgtcctatagtgttaggttctaacactatatccccgcagagctatgcataaaagtagagatttctttctcatgggtcttcatttccttatgatgctcccaaattcacagaacccaaatgtctgtgagctgatgaataaagcatggtatatccatacaacagaatattatttaactgtgaagaaggatgaggtattgaggcatgctacaaggagaggggatctttgtgtgtgtgtgtgtgtgtgtgtgtgtgtgtgtaatattactttattttgttttttgagatagggtttctctgtgtagttttgtagaccaggccggccttgaactcacaggctgcctctgcctcccactcccgattaaaggcatgcaccaccactgactggcaaagaagagggaatcttgaaaacacactaagcaaaagaagtcagctccatgcaacagtatttcctatattctatttagatgaatttctaagaataggcaaatctatagacagaagatagtttagtgataaacttatgttatatggggttgagggtaaataggatgattagtggctagtgtgggatcttttggggaggtaaatttgtgttttgggactagacacagaagtagttgcagagttctgggactgcttgaacagtcattgctttctagacttcaattggtgaactgtgtaacatgtgaacaataccacaataaagctatagaaataaaaaggaggagtcagtaggatggtcactgtcacaaaacaaatgtgaaaccagtgatgacctaagaccctaatgatgagaaagtaacaagttctgtctgggagggataagagaaatttaattagaagtctgggtgggatgtgaaatggtcactaaggaagatggtatggtggttcttcaaaatttagaagtagaatcatcaaagtagggatctgaaaaatgctttacacctatgctcatagtattattattggctttggccaaagcagcccaggcttccgatgccaaatgaatggataaagagaatgtgtgtgtgcataagtgagatagtatgtagccttaaaaaggaagggaattccaatgtatactgcagtgtggttgaaccttgagggcactgtgaaaagtaaaacaagctgtcaccaaagggtgaataaatacatgcaacaccctttatatgtatgcatttgattttactacacacacacacacacacacacacacaaaaaaaaaaaaaaaaaaaaannnnnnnnnnnnnnnnnnnnnnnnnnnnnnnnnnnnnnnnnnnnnnnnnnnnnnnnnntttttttttacaaacacacaaacaccacaaaacaaaaaaaaaaaaaaaaaaaaaaacccttaaaaggcttgcatttggagtttacattggagaacaaacttgggatctgggaggtcagtggtctgggttttatcttaggggctctgtggccatgggcaggtcatacaagccttctgttgctgtgtctttattattaccaggacatggtgtttttgtacctcacagggttgcaatcagagcacttgaaataaatgtcaggtgactattgatgtctgtcaggtgtggtgtctttagaggtggagccaagagtatagatgtgaacttggggataccctgccagctcagtgtcagtgaaacaagacaagtttcatgaataagcataagacagaccccacccatgaaagttatgttaactatgtaaagacgtgttatatttgcttatgctgtgggatgttactctgtaaaggtgtaagcttcgtttatttctgctgcatttgtttaattatgtaaagatgtgttgcatttgtttcaccttgcctgcctaaggcacctgattggtctcataaagagctgactggccaatagcaaggcaggagaaaggataggtgggactgccgggcagagacaataaataggagaataatctatgacagaaggagagacggaaggatatgcctggggcaggctgggcagtcaccagcctgacaaacatgagaagcaataaaagtaagatatacagaagaaaagaaaggtaaaaaatctgaggcaaaaggtagataaagagaaacaggttaatttaagttaaaagatgtagcctaagctagtccgagcattcataactagtaagtctctgtgtcatgatttgggagctggttggtggcccaaaagaaaaagcctggtacagttatgatttacccaatttatttaatttctaaaaagattttctgaaaatgttcttaaaatggaggcttcccagtaggatattatttatttcaaaagttttaatttgtttaaccatcaggctatggtccagctctggaaccctcttggcattctgtgagctggcaaaccttggccggatcttagcagccaagtcccctctttcgaaagccccagggggccctggcctcctgaactgggttctggtggtgctcacactgccctcctggctggctggagttcatgtttcatctgcatatgcttccctttgttgtcacccaggtgaacttctgagctatgtaaagaacacccaatcttgtcctgatcaggacacccattgcctccccatgcagcctacactgtggcttccaggtcatcccttcctgccaccatggtccccttagacatcagcatggcacatggcatctctttccctgccttaccccaggaggacacctccacccttccctgaacacatgcaactgctttaggaaccccctccaggatagtccccattgcatgacatcatatcacaaaacaatcaactttagaaaaggcagatcatgcagcatgcactagaatttcagatcaaccctctcaaacttcacaaagcttggctagatggcgatggtgcacagctgtgatcctagcaacaaggaggctgaggctggggaggattgagagttgaatgctagcctgggatatgtgatgaaatcctgtgtcaaaaggtgaggggaagaagaaggaagaggaagaaaggggagaggaggaagagaaggaggcagagggaagaaaagggaggaggaggagggtgaggaggaataaggagaaagaggaagaagaggaagagggtgaggaagggggaagggaagagagaaggggaaggaggaagagaagaagtataggaagaaacatgaaagggaggcacaagtgttgtcaagtaaagattttaatgattattttatttaatcttaattttgtcatgtaaggatgccaatgaataaagcaaactatatcgtttacctttattatcatttcataagcgaaaggacggcactagtagcactaaattgaaacagacacaatttcataatttagaaactgcataaattagctttatgaagaattcatgacattgtctgctaattttcatttggatacagatgagcagaaccctgtcaaagaccaacagtccacagccatccattccttcaaacaacattcggggcagatcagagtgtggcagtaggccaaatcccaattatttcccaaggtaaccagccagattggcattctttgggccacttttgctaaattaggtttctgatcacatggcaacccaccctgctgatgttaaccttggcaaaaactatgttccttcttaattccctttttttctacaactcccagacagcagaggtcaacacaaagatacagaatggaccccacatgccagttgtgacatttctcatgcctcatctcaagaaagaaacaccagagctgcctcttcatggaggtccctatccatactttttcattttatgttaataaatatctttagaaagtttaatcttcaacagaaaaccacaaagaattacttaaaaaaaactcccatgtttcaagtctctgcacttttggagacccatttataagctggtgactatatttagtgtttccttttcctctaaatatttatgacaactctctgtctgcgttctgttagtctaaattctgttccaagtcgtgacatctgttttcgaaaatttgactttctccctgttccaacctacacatgttcttattagtttagaattttcttcctctctccttttaaagatctattttatttttaactatgtgtatatgtgcaggtctctgtgtggagtggcagaagatgagaggcatgggattccctgaacctggagttgttagcttccccattggagccatctctccaagagttctgaagtttctctttaatgctgaagtgagtgaattgttttataacctgtgggtgtttaatcagaatctattacttatctgatgtttcttgctgtttccactttttcaaccataagacactttagtcacttgacatatagctaaatcctgaggaaaagatctgaaattttatgtctccctaaattaaaattagggccccagtttgtggagtgaacatgccatatgtctgcctgttcacaaaggacacctgcaaaatggctcttgtcaacagacagatcattctcatttttttgccaataaaagtcttgaccctgggaccctacagagagatcttggatcattttctgtggctataacagaatacaacagattgagtaatatataatgtgaacatcttctcacagttctggaggccccaaagacagatacaatggggccagcatcttgttgccccttttgctgttccataatatggcagcagtggtctttagcttgcctctgttccttgtctggcaaagttacagatttcactatgacttcataaaaaactaattactttgcaaacaccctgccccagagtttgaccaatctgtgaattttgggctgaatttttggagctatgaatctggagccccagcccatggaggtgccacacacttgtgttgtctctgcaaacctccatagggtgctgtctcctaggccattctaaatcttgttaccttgacaataaagattagacgtcacagcagccaggagatgatggcttactctgcactcactcttatctataatctgctgacccactcatggaccagagcctctaaaaccacagaagtgaggtcccacctggggtccttagtctcattagtaaaagaatttaagaacactcacgggccagagagaagactcagcagttaagagcacttgctgaccttccagaacagggttcagttctcagcacccacattggtggctcacaactgcctgtaaccccagctctagggcatctagcaccttctggcctcctgggaacacacacacacacacacacacacacacacacacacacacttctcacagtgaattctaaggaacacacacagttcacatacacatacatgttcacatacccatacatagagacacacatcattttcttttaaaaggactcagaagttcatggacaattttgccagagtttaaaagaatccctatcctgaacaaaccaagctgtaaattacagcaactgtgtggaggacttaaggagaaggccatgctttctgaactatagacacatggcttttaagcagctgtatggcagggagggagggaggcttagaacagaggacggaagcctagagtatcagaggaagcatacctaggtcctggccagcacccaaaagaacaagacagaaaacagaaaatggaaatgttatgcatttctgactcaggcttcagaaaggtggacaaacctagcagagccttcttggtggtttgtagggactgtgctggattggggaggagcatgggattctgggaagggaagtacagaagaataatttctcctttctcctctctcttcagcatagccaaggtaagccctaagggatgtgtgctcccccccccatccccacattgatctggcccaactggactgttaggtctctagttctattttcttgaccagaaggatttatttttcttgcttgggcttttactgctattctttaaactgaccaaattggcctatgggcatatctgtggggattttcttgataattgatataggacagcccagctcactgtggacaacaccattccctggacaggtggtgctgggctgtgtaagaaatctagctgagcatgaacctgtgtgcaagccagcaaagatttttcctccatggtttctgcttgagcttctgcctcagttcctgctctgacttcccttagtgatggaccttgaccttataagctgaaataaaccctttgtcccctaaattgcttttgaactgaatgttttatcatagcagcagagatgaaactagaagcagaaggatgatagtatcttccccatggcctgaatgctgggcttgaatttccctttttggcttgggaggttgtagaaaagcattctcaggagcaccctttctctcagcactcttgctacagtctccaaggtgaccaagtgtgagccacagatgtggctaaatagttcataggagaacattggcccttctcagcctacaaattatcacagattagtcacccagactgggtgtcctggaggctcctttatctgtcttcctcatagttcagcttccaaagcttggcaaacagccagggaagcaaagatagatgcagattaacaggcagatgcaaatgtataaactggaagacccagactgtcatgcagagacacagattaaagattaataatctaggatgctagattattcatgacacagctaaatgcttgtgcctctggcggagacccaggtttagatccacacaggtgagcacaagccacacccgtctcaaatgcagagacagggagggagccacagctttctctgtagtcccaaagtgactggacaaagctgagttggaggaaatgatggcttggaagtttccatagcagggtgccatgcctggggctcattacctgatttagctccaagctttattgacaaaatttaaatgagaaagtagtagtagacccctgaaagccaaaaataaacctgtacactccaggttattttagacaattccaaataacgcttttctgagtccaaacttttcttttctctgagagattgcaatgaaggcaaattgaaatcagattacttacatttgcaaacacacctcattttttctatcattattgactaacacatagaaaacaggctattttgctttgcaatctgaaataaataaggaaaaactactccacagaccatagtttgcttacttgacaaaggtctaaatactttaaaaactggatttcccaaaggcagccaggtatttaccacagtcatacaaatcttttccaacaataaggtgctaattcctggcttacttcaagccacatgaaagaaacagtaaacccagaaagttgccattttaatggttaaaagaggagataaagacatatttgtgtaacggcttctgggaaaggtactttcatggtggacttgattcctgccatccaactgtattcatgcaaaacaaatcaaaacatgctgtatctctttgggcaaagcccagtgtcttactattgagatgcatggggataaaggtataatagattattttacatctgaagaagtgtctaagaagctccttgtaggggctggagaggtagttcagctgacagtgcttgcccagcctgcagaaagttcagggctcaattcccagtcctgcctaagatgggcatggtgggagggtaagaagttcaaggtcatttctcggctacaaagggagttgaagccagcccagactacaaaacctgtgtaaataaataaagcaagctactatcataggttgacacttaaaagaacaactcacttctgccaaagtaagcatgcatggggacagcttatctctacacttaagagggatcataactgatccataacttgtggcaacacagaaataaaaccacacatggcatcagaggcatagaagatgccccagaaagagacttctatgaataagcatctaattttctggaaaactttattttttgaggtatgtgtctatgtctgtatccatctagggtatatgcacatgaatacagttggccacagagaccagaggaggtttgttagaaagagttctggatgggcttaagtgatggcttagtggttaagagaatttgttgctattgaagaagacccaggatcaattcccagtacccacatggtggctctcaaccatctgtaacttcagttccagggcatctgatgcttccttctgatctccatgggtaccagtctcatgggcaggctaaacatttatacacacaaaggaaaataacaaatcttaaaaaatactttgaaaatcctttacttaaaaaaagaaaaagaaagagtatctgtagctacagacaactgtgagccacctgatgtgggtgctgggaactgacctggaccctttgtaaaagcagcaagtgctcttagccactgagccatgctgccaggaaactttacatgatcgatatgaagcttcaagacatgataaagaggcaatgagaactgaatacattgtgagggttttttcatagaaaattccttcaagatggtagaaacaaagatgcttgactaaaagcaaaggcaaagaataaaactaacacttggaaggcactgagctattaaacacacacacacacacacacacacacacacacacacacacgagagagagagacagagagagagaaaaagaaacaatgaatttcccctccctgtcaaataaggttcatagttttctttgtataatgtctgtatatagatgattagagtcaactgagtaaatttaacagtgtcaaaagtaattttagtagatttgaaagagaagagtttttccagtggtcctggaaggctgatttacaaaacagtcctgtcattgggtcatttcaaattccaaatactggagtcctgattttaggaattcactcctgccagcctggctgctttagatgcgtgaccttcacaaacactgctggtcagtggtgtttggaggcagatgggctgcaacatggaaatcaagacttgaataaaaatgcagttggaagtacaaatatttattagcaaacaagtacaaagtgaggcttgcaccatctgttcttgcaagctcagagagcccctgctctgtctaatggctgtcctcccccgccttgcatagaaggctgcctgagcaagagtatgcagctccggggaggaatgattcctctttcagccacactgggcttacagcctttgggaggtgtggaaaccagggtagggttcagatcagcacagtgaggctggtgagctaatgggctgaccagcctcagctctcttccgtccaaggatgatggtattcgcacaaccttttgagataactccccagcttggctactaccaaattaactggagtaaaattacctcctgacattcctcaccctgaataaacctccagtaccagtattttgacagcagtttggaaatactgtggcagcccttgagggcatggactccaggtaagctatgtttatacaaatcaactggctctagatgtgatttcaattcaacacacatggttgtaactcagtgttagcgctgataagttttaaatggtcacgcagaccatatagattagttctgtggtttttgtcctttcctatttacttttgtgcctcgtgttttctttctgagccatctgtcaaattatgtggcttccattctgcaaagattcacaggtgaacttgaaaacttaggagagaaacagaaaactgagttgcatatgatgtcaccttggttttatgtgggaaggaactgtcactgaacatgtgatgaataagctcttgcaggtgaaataccatctctgcatacccctctttgtgtctagcttgtgtttactctatgtcaagatgtattttatggagacaaagccaaacatgcacagtcctaatcacagcctttgctgtcaggactggcaagtgatgtttctgccctctggaaactggaatgtagaagaaaaactacaggaatctcaggctctcatcttactgttgccttgacgagttctccataacttaaacaaaaacttccaaaggaatccttatttaagtgatgttgttaaggacacaattctgtgtagattcccttgttaccaaattctttttatctttaaaggtttattttattttatgtgtgtgtgctttcttgactatatgtgcactgtgtgagtgcagtgccctcagaggccagaagagggtgttctatccctcagaactggagttaccactcactgtggatgctaggaatgaatgtcagtcctctgtaagagcagcaagtgctcagatctgcagaaccttctctccagctctggatgttgttattcttgaaggcaggaaggaggaaaagtagacataataattagtgtctggagggacccattactgtgtctacactttcctgctcacgtttgtctaagcccacacttcccagagggctctgaagtgcatctgatgacaaaattcccgttctgtgtaaacaactctccagggtggttaatgtgatttatggactcagttgtatagagagacacctgggatcttagcgagtcacacttcttgggtatgcagacggtgacagctctgacccaaggaatctattaacagttttgaatagacgattggaaagtgggtggaactggatagaggaagtatgtcattggggtgtgacctttgaggttatagcttcccacagtcccttcctatcacggctctactctgcttcctgacctttcctctacactttgcaactgctgtgatgcttctgcctcgtcacaggcccaaatcaacagaaccaagcaaccatgaaccaaacgtctgaaaccgcaagccaaagaaaatccctgctgctttaagatgcttccatcgggcttctgtcacagtaatgtacaaacagtaacacactcccattgtgctattacaaggctggaacatactttgagaaatgccggtaagaaatgattttagtgtaaatgaggcttgaaagaaaagtttatgtctgtggaaatgctcgtttggtgaagtgctggtcttgcaagcacaggggtgggggatccccagcatccatgtaaaaaaacaaaacaaaacaaaaccccccaaaaatcaggcacaatggttctataatcccaggtggaggccctggagcttactggccaggcagtctgactgaaccaaagagctctaggttttgtgggagagcaaatgaagagacactgggtgctttactttcataggttgtagtgagatatccaccccgcccgcatctgatgcactgaccacgctcatttaggctgtgtcagtgcatctgatgcactgaccacgctcatttaggcgtggtcacaggtggggatgtgatgagggaaggctaggtctggggtcctggatctcagcttgctctcttgtttcctgttgggtgtcggagagcagcctgggtgtggatccttggagctggaacttgcaggtcatcagtttcttatgtaagtgacttctccccgaataaaattaaccacgatttaaccaagtcccttaatcttaatctgtgccactacagtaggtgctttaggtcttgtcattaggcctacagagaagcactaaggactagtcatgtccatgtctagtaagtacattgcgtactgagctggctagttttatatcatgtcagcttgacacaagctagtgttatctgagaagagggagccacagttgaggaaatgcctccgtaagactagcctgtgggcatgtctgtgggatattgtcttgattaatgattgatgtgggagggcccatcctacagtgggcatggccaatccaggcaggtggtcctgagttgtatcagaaaacaggctgagcaagtcagtaagcagcagctcgtcctccaggttcctgctcttgagttcctgccatgacttcctcagcaatgggctggtaactggaagtagaagatgaaattaaccctttcctttccaagtttcttttggtcgtggtttttatcacagtggcagaaaccctaaagaagacagaaattggtacaaggtcatagaatatgtctgtgacagctccggccatgtattttattttccaagggttatggtggcatttgaagtttgggctggaaaaaagctgttgaatgttttgagttcagtgttcagagcttagggggccattctgtggatgcacagaagataaaaggcttgagagaatttctcatgatcaagatctgacttgtcaagtttcaaagggaagttagagaaaccctgaaagactatccatggcgtgaatattttgagaattaagaatttgtgattctggtcagctggtgctgaagcatcagctgtgattaacaggagatcaaatccactgggacagttaactgatgccggtcagcgggatctgagaaattagcagggattagcaagagaccttcgtcaaggaggtgaaatcttctggggagcgttgccttggagtcagcacacagtagttgcattagaggcggctgaggctgctccttattgtagcagttgataatgtgcaagagattcccaggtggtactagttttaaaggaataaagggatcatggaaagcagctggggtgtggtatggtgagaaggttaaataggccatggtgagagagactgaggcttggcaccacatggcagggtgtccttggagaaggtccaggaagaagctgtcggtgaaggtgcaacctaggtacagtgaacacccagcattttggagaatccagtgtcatctcatggccaccaaggacagctgcagctgtggtgtggagctgatctaagcctatgagacaagctgtctgtgctgtgaatggcagaaccagatatgtgcagatgtccaaaccctttggagctcagaaaatcaacagtggatcccagacatcaaacaccaatggagttcacattgctggatgtggttttgtgttgacttgactgtgagtgccctgaatcgtcttctggcacaagaaggtatgtgacttatttctgatttttaatgggagaccacagttgagagagactggtgttttggagagactttatatattttagagctgttttggatactttggagagggtttgaaattggagaaactaagtgtcttaaagagatgacattttttaaaggggtagaagttttaaagactgcactacagccaggcttgatggtacgtgtctataatcccagcactcaggaggcagaggcaggtggatctctgagtttgaggccagcctggactacagaacgagtcccagtacagcttgggttacacagagaaaccctgtctcaaacaaaacaagcaaacaaaaaaagactgggacttttaaaagttggaatgttttataatgtggtattaatattaacttgccatcttggggacaaatgagaaaggaaatgttctagttgaataatgatgtgtttgtgtgtcaaattgacaaggtgtcaattgtgctggttagttttatgtcaatttgacacaaatagagttacctgaaaatcgggagccacaactgagaaatattgggctgtaggcaagtctgtggggtctcttgattaatgattgatgtgggagggcccatcccacagtggtggtcccgagtagtgtaagaaagcagattaagtagtgtggagcaggtcagtaagccattccttcatggtttctgttttagttcctgcctccaggttcatgctatgttttgagttcctgccaacactcccttctgcaaggaactgttaactgaactgttaaccgtaagtgtaagataaaataaacttccccagtcaaggactattttgaggttgccttctctatctaagcttggtagagcagaacagctcttggctgcttgtacagatactcaaggttttcttgtggttttcacctttaagcatccttccctcatcccccctttacttggtgcacttctgatttgggcagttataatctgaattaagcctagtggtcttttcctggggggtcatgactccataaaactttctctactaaaatttcagctctaataggatggtttgatgtcattctgcccttctgttacatttgtacatattatttcaactaattaaacataagcaacacaattggaagtatgtcgttagtattgtgtttagaaaaggaatttgtgtcatgggatccaaactgagggaggggagggcagtgggctcattttcaccatcatgtatatatttggatcatatctggatcttgaaattcatggttgggcttccttccttcttgctttcctgacacttgtaaagatgtgttcctggagttgatttgtgtgtctttgaggatgatgtgaccatgaaaacgatcatgaccagattctgtgaacaactggtgtatatacagtgctctcccaacatactgtgagggctactgtgttgccaccatcccaaggcatgacatacccttctctggcctcacagcatggtacagaaaggctggggagtacacacagctggccagttgcagagcctggcctctgttcagatctaggctgttttcttcactcctagcctcccctccttccagtgtgaggacatctgacctagatcttgcattgaggcagttctttccctatgtacaccaggtctcaccaaagagtgagctggtgtaatcgatctatctggggacactggtagatgaagtctgtttctgcagacctagaagggctcttggccctcgatccagttcctttactctgtaaccaaggaaactcgaatccccagaaaccatacatacactgttgggaagagagaaatcagggctacagaagattggcattcagagggactcaaggaacaggaaggaaccatgtgggtgaatggatatggctgtctgttcttgggatgtgatgtgactagccaccttgagtccttgccctgacttccctttaacaatgaactatataacccagaatatgagtggaaatgagctttttcttccctaacttgctttttgtcaggatattttatcacagcaacagaattgaaagctaggactgtagccagagaggggctccgcagggaatcagttgtaaattgacatactggattgtgaattggggaggggacgtttctagaactttcttaggaacgcgtgtctccttcctttctgaagcaaaagaagaaaggcagcagcaggcatgctaagcattcagaggtagtatctggaaagtgtgaatggaaaaccaccccacagtccctaagccgaagactgcagcagtggctctgaggtgatgtgtacagtgtgtctgccagtaaatcaccggaaagaaggaacgagtgttgagaaaagatgttatctcctgggcatggggagttattgagcatctgagtcagggagcagggttttgtgggaaggcaatttcctgggtcctctcccaaggacaatgaatcacagctgagacctgccacactagggaggaaggccagagggtgacgtgtccagaaaactggaagtgactgccaagcactcaggcaagactgtgtggacactttctggagccccgtcagtgctccactcagcaccaagtgtgagatggccctgcttgctcttagggactcaaactagttggtgtttttttctccccacattctcatctaactccagtcctattctgccccttgggaatgcccccacataggcttcttcctaaatcatacccacctatcactgaggagtagaagccgaagaggtgggtagttagtgctaattaaaagcagatcaaaacttttttgagacagggtctttctgtgcagctttatggccttgagttgatgagagctccctctgtcttggccttgaagtgctgagatgacaggtgtgagcatggtatctagctgttggtgttaattttaagtctcctctgtgaaggctcagcagccagtgacaagtgggaagacatcctcaacagggattgtgtcactgcagcctggttactgcaggctgccttgtgcaggggtcagggctgtgagtccaggagagctgagacatggttggggcaattccggaccctttctcgcccgttttcctcagtggatggttactgcatggggtaaacagggaggtgtgggcatgggagtgtgcagatggtctgtcctagcacttcccacattcccagtgaaagagaaagccaagccatcatctgagagtgacagggaaacgggagcttgagatgaaagacaatagtgtgacacagctgtctatagaggggggggctgcagcagtggcaggggtccccctgaagcaggcggctgtgggtttaaggagggatcccacatagaagagaagtagaagctggtttcgatgtgttgctgtgataaataccatgaccagaggcagcaactcggggaggaaaatgctgatgtttccgggtcacagtcaactgttgcaatcagggcaggaactcaaggcagcactgcttgctgttccatgcagatcacctccaactgtggaactcacagctgaggaagtagagcaggaaccatggaggatgctgattgtaggctggtgcatgcttatctagctttcttaagtagcccaggaccacctcctacccaggaaatgtgtggcccacaatgggctaggtcctcttacatcaattaataatcaatataacccccgtagacaggcccacaggccaacttggtctaggcaattactcaactgaagcttctccttttgaaatgactcttggctgtgccacactgataactaaggtcaaccacaacagtcattctctttaaatatgatccattttaaggcaaacctaatttttacacatacactgtcaaatctaccagaaagcttattttcaaggtcttttgatgtatacagaaatcccacgttttgagaatgacgtaagtaccaaccttagtcatagttattgaactgggaatatgacaaaagcaagttgttggtgaaagtttccaccctggcagcctggtcccacaaccgcttcaaccccaaataaatacacagatggctatattaattataaactatattaaattataaattataaaattaattataagaagcccagtagctagggcttcttattggctagctctgtcttgattgttaactcattttgtgttcttatcttactggagaagggtccggtgcatcctaccttccagttctcatttggtggctgctgtctgcctacacttcccagaattctcctcatctcctagtcctgcctatttccctgcctctattggtcacagtattcatcaatcaataagagaaacatatacacaggacaacccgaatcagcaagtggtagtaaattactcctggtatgtgtgtgtgtgtggtgggggaggatgggtagcagatagaagagccagcgaaagccaagagcagtattaggaggcctacctgggctggctcagtcccagaacagcagtctcccagaagatgtggatgggtgcagagaggctatggcagtgcccaaggcagcagtggctgaggatgggcagaccatggtaacacacagcatgattgccaagttcatgatgtggaacaagttcctgatgtggaacacgctggtataggtagcaagtgaccaaaatgaaggtccttcttatggactgagttcaggaaggggaggagagcatggagtgggtggggcgtgggaagggaaccaccacccagaagggagtgccagtggccagctggtgttcatgacactcttcactctctgagtgcaacctgattttctactctgtatattaaaacatggtgcctattccattaggctttgagagtgatatgtctggattgcaataaattcagctgcttcttcacttccctgtccatgctcttgcaggccagcggtctgccttgttagactatttacctgtaatactttctggatcaagatgagaaattaatacaataaatcatcctcttgcagcagtgggtggatagactcttaggtgattcccatggcccctgcctcccattgtccctatctttgtgtaatttccttcctagggattagctgctggtgaaagttccagctcatcatatctgtggttccacacactgtgtgaattttcttctggctggtgggctgtggactgctatgaggggttgcctttggagaagcctgctgccatgttgaaaaagagcttgtgaataaggaactgggagaaggctgtcactgatgagaatgaccttagcatagcactagtaagaagttggggcctcagtttgcagcaaggatatgaatgataccaggagctaaatgaagttagaccatcccagtcaagccttcagaccaacactaagccttgcagaggacccgactaaccatgcctggactcctaacccacagaggttgtaggtaataattgtgtactcttttcacccactaaggtttttcatttattaaacaatacatagagtaatagtactctatatttgcttttcattctctctttaagatgtgtttgggtcatggaagaaatacctgtctgatgacctttgtcagagagctgtagacctcttaagcaggctgatgaaggagatgagtgtgagtgatgctaggtgttgaataagagccagggcaggagtataaagagtttgagaccagccttctctgcatagtgagttcttgtcttagaaaataaaacaaaataatagaacaacatctcaacccaagatggggcaagcctgcctctatgtctgggaagaggccacacctcatatataaactctgcattttcaccactctctcacagctggtcactacactggtcaggcagcagttaccctcctgtgtaccagaccatcagtatgttctaggtaccgagctatgttttatggctcatattggttatgaggcatctggtgttggagaaggcctgtgcatggatgggtgggtggaaggggcaaaaggtcacttctagggcatgtgaaagccttcaagtcaccctgccaaggatattccaatgttcatatccatgcctagacatctctaattgagtcataattagacaagtcctatcttctctccaaaggatcctatccaagactctacatttgcaggcatgccccatctcaagatagccagtgaacatgtgagagaaagcctcctccaaacacatcgctcatcaataacatccagtgtttcggcttctggtggttcaggggagctacattagagagtacaagaggcaggggaactataaaaaatagaagcaacggcattaattctcaaacaatcaaagctgggccagctattttcctgatttatgttaccctttattgcaaagctgcatgccttgtccagcttaaatctgaaagagccacaagggaaactcaagtgcatctccagcctgtgcccctcctgggtataaacgaactgcacacaagaaaatagagtaagcggccctcgctgcttaaatactgtttatttctaccgtgcttacttacattccaggggggtgattattctaatcacaagcattgagagcaaattagttcatcttaaaattcattattgacaatggacttggttcaatactgaatttctaaacacatctccatatccaataaagttgaatctggcccctgtgtgtgcagagaatgaacggagtgggagtggaggtaggtgggtgagtgatggggaggccacacaggttaggagcagcctccgtctctttaaaaatgtttcattgatttttaagttggcatacagtgtaataggttttatgacggcattttcatatatatgtcattacacttcgttcttactggagcaccacacccccaaccccactaagttcccttcttctttcaaaaatctcttgttgttcccttccttcccctgctaagtccccatatacttccattgtcttctctttcctcttcctttagacctcttcctcccctctcatgcccttttttctccctctctctctctctctctctttctctctctctctctctctctctctctctctctctctctctctctctcacacacacacacacacacacacacacacacacgcatgcaggcagcagacagacaaacacacatacagacatacaggcagacacacagacatgcaggcaggcagacagacacagacacacagagacaggcacacaggcagatacacacacacacacgcacacacagtcacactcacacacagtcacactcactccctgatgtcacacccacccatggctcactctccaccagctgtgccaatctctttgctcttctggaatgttctccagaactcagggccttattctggaatgttctccagaactcagggccttggttactttcctgttagttggaatacatcctacaagtacccacatgactcgttccttcacttaatgtctctgtctaaacttctgtctaattctcagaacctcactctgtttcatgcaaaaatgggaagacagttataagtgtaagagtccatttcaggtgcttagcactctggagaaaacaccagaggtgtgagagagtgagcagtgtgtttccatgtaaaataaaatactttggtatattaactacttttttgttgttgttgttgctgctgttaccagtttctgacaaaagcaagttaagaaaggaagacagcttggatgcaggacagcacagcagcagcgtggtggtggtggtggtggtggtggtggtggaggggtttctggggatggtggggcgggaagcctggtggtggggggattcctggctatggtggggcaggaagcctgggggtggtgggattcctggctatggtggggcaggaagcctgggggtggggggattcctggctatggtggggcaggaagcctggtggtggtgggattcctggctatggcggcaggatcatgaggcttgttcatgtggtggtggggctcgggtggcttggcagaaagattaatggttacataatggtgtcaggacgtggttttatgaacttccacataaaagcttcacaaaagcttaaaaaggggattttagaagcaaaagaacagagacaaacacaacttcttggtagcagcattttctcaggtggtctgttttgcagagacaagcagaggctggaggctcctttaagagaggcttcctgactcagcataagtggcaaaaactgcaaggctctttagaggtcttgctaacaattcagtggtgtgtacaagcagctggccatggcagtgaccacatctccaagccggcagcatgctgcttgattgcagcgtagaccaaggcagtgagcacagctctcactgctggcagtaaacgtatgccctccatcttggaaagacaatgggtaaaaaatccactgctttaattttagcagtgttgtttagcagataaaagactgtgtggccagaaaaaggtaaagatttacagtaaagcagattcagatgaagaaaaacctccctctaaaggttaacagtgtatttaaaaatatatgtagacttgtgagagaaaagaaacaggataaagtaattaaagaaaagccggtggtggtggtggcacatgttggtaggatttgctgaaggaagcagaggcaagcagatctctgtgacttcaaggccagcctggtgtacagagtgaattcaagggccgccaatgttacacagagaaaccctgtctcataaaaggaaaacttaaaagtaaaagaaatagagtaatgaaaaagccacgtaaggatggaaaatccacagtctggatactatatgccataattgttgtctttaaattgtttgattgccgaggaaagagctacagctgctaaaagatatttggttatcaatgctgctaaattaatccaacctatacattttaaaaatgctttgacttcaaaatttaagtctaaggacaggctacttgggaaaagaatttctgcttttgtttacacaggaaatgaaaagctgtggattccttccagactaatatggtttgatcaagcaagaccccctgaagcaatggcccaactgattctacatccaaaacagctgagatgatgcagtcagaatccattatagaaggatttctgtgttttatcatgatccccatggtatggacatcgcccccccccccccaaccaccaggaaccagagaatgaatgacacccaaattcacaaatactgtttataaatgtttgttttcatttaaatggggttgggctctctttctctccctccctctgtggccccagccctctgcctgctacccgtggatcaggatataaagctctcatctacttctttagcaccatgcctgcctgcctaccgccatgttcccaccatgataatgatggactaactttctgaagctgtaagcaagcccccaaacaaatgctttcttagggtcagcactccgagcatctaatctcagctgccctctgagacctgaccggaactcagggagagcaagactgtctgtcctcccagaccaaaatcccacacggccaaacaggcatggtcagcgccacaggtagcctcccaggaaatcagcatgggcccatctatgaccaaggcagaaagccaacaggtagtaagcaaagcaacaatgtgaacagatgtggagccctcagatctactacctcaccaggttgtgtgtgtgtcttcattttgagtcggagcacaggggagtcattggcaatgctctcctggactttgaaagagagatgtacatatgcactgattttcttatccttctttctttttgttggtgctagcaattaaacccagggccttgtgcataccagccaaacgctctaccagctgagctgcattacttctattcttaggaatggtctgattgctctctctggacagttaggaggagatgatagccaaggaaaggtgcctcttctgctagttgacctcctgtccttatgaagcagggagggatactgatctcatttctctgacttcatggttgcagatgacggcagagaaatcaagtctgtactaaagacagtagtatgattgattcattggatgcaatttgtccttataccatttctaatttgttattggctcttagactactaaagacagcttactggagagtttacagttcagtttcctcatttcatatatgagaaagaaatctagaatcaccgataaggagactagagagatgggtcagtgggtaaagtgtttgtgccacatatatgaagacctgagttcaacccccagcacccatgtaaaaagccaagctcagtagtaaagacttgtaatctctgtgctagagagatggagatggacttctggattctagctgaaccagcaagttccatgagttcctctcccaaaaatctatgggagaatgactaacaaagacaccagacatcaactgccttcttatttatatgtgtacacaaatttaaaagacatggtttccagtttcacttctttgggctttctactgcaaatgactggatttgttttaattttgttgttgttgtttggttggttggttggcttttacttagctttctggctctttttagtgttaatttcaagttgtttcaagaacagaaaatattaccagtattgtacccagtatactcagaaagagttatgactaagtgataaaggcatcaagttaaaaaacaaaaaacaaaaaacaaaaaaaaataaatggggttggttataaatggtgatgatcacagtcaatctctttttaaaggaaaaaaggggaataggatatagaaaggaatactttgcattggtatggattttcatttattgatacaactttaaggtcaattttgtgatatgtatatgtctcctcttgtttaggtattgtgtttatacagatcttttaaaatgcaatgcataattaaatacagattgtatatagtcaggtctaatagtcaaaacttacagttatgttagttaggttttctagatatacagagatgtatttgaaatggatagatattctccaaacctttcaaagacctacagaatatatggcatttaaatggtttagggtttttcatgacagtgagacacaactgctcctggcataccaattacatcagaaagaaggatgggcagtgaagaaactcaatatggagtttgccttcaacatggcaagattagccatttgggcaaaaaaactgctcttgcctggactgtttgataaactggacatgaaggatccacaggaaagtgactgctgaacttgcaaaatgagacagtcctgaagggttcttgcttcatggagaagtctgccagatacactgtgacctataggctgaatatggatgccccaacgttacagagaaactttgggtgactgtccaggtagtgagatgtctctgtcagatgtagagtttatattatccttctgtggtctttgatggagttgaagacagacagttttctttagttattataaaaagataagctacatataagaccttagactcacaaagataaaatagatgatagaatattttctttaaatcttgctaaatgttagtgaactaaatatcataactatagttcttacttgataactgttttgttatatattttactatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaatgtagtaaaaagaagtcttgtgatccaggtaggaagtgacatagcaggcagactcagaatataagcagggacaagcaggaaatccctctcttcctcttcctcctactctcttctctgggctgtcaccctgtgagccttacaagagaggatgcatgccaccggcaccctggatctgataagtctttataaatacatagtttaatgattatggttgataattaagactaactagcagataagaaatcctagtcattggccagcagcattgtaattaatataagactctgtgtgttattttgggtgcccatgtggtggcggggcttggacggcttggcagaaagatttattgttacaggcaagcatggtggtggtggtggggattcctggctatggtggggcaggcaagcatggcagtggggggattcctggctatggtgacaggatcatgaggcttgttcacatctgcgcaggtcaggaagagagagaaatgagctcacatgccaatggcagtctcatttgccacccccctttatccagtcctgaactctaacctaggcatttcttagttcaatcaacttgacaatcgaaattaatcatcatgaatccatcatgaatgtattcaaacatgtctcatcaatctacaattgaaatgaaaattttgagggaagataccacagatttctaaaacaaaagcataaaagcaaagcctggggcaggggcaagcaaagaaaaccaacggccagagccccatagcttctcttttctctgaaggaattcagatactaggctacaaacaggtcacactcttgtagacacatgtccaatttccaaatgggtttaaaatttaagaaaaaaatttgtatttcctaaaaaaaataataatgctttaaataactttaattatctactgtctttgcctatgagtgggccatattttttctaatggtgtggtatccacaggcataaaatatattttcagtaggaaagatttcaccatcattatgtacaggaagaaaatggtgtgaggtgatgtccagcccatagcacaagcagatccctatcagatgtatgggacttaaactgctgcaaggagggtcctcaggagggtgggctctttgcagatgagctttgcaatttagagatgaacaatgaaggcagggtattaatgagttcaccagacacaagataaatgataaatgggtgttttatcgggggacaacttacacagataatagtaaagaaccatcacagagttcctgctccagaagaagcagtctctgcccttccaatgctctcggcacaacccaactgatagtgcccgaccctgcttctctaccttcaggcagtcatgggtgtacctgaaaccacacccaaaagggtgtggccgctactgcaattttcactggcaaggctacatgccactacaaaacgacattcccctttcagtaaagctaacagtttattgttggcgtctgcttctgtcatccatccattccttgcaacaactgaactggcctcactaccttctgacacactatgccatgtccagtctgcactgctttgctggggtctgtgtccaggcctgtgaggaggatgcagccatcccttaagtccccaggtctttggatcctggtgcctgacagtcaatctatagctagtctttttctgtggtcagaggaaccactttctggttgacaataaagcgaacctcacacctcatgtttgtcaataactgagcctcaaatctccttggcatgagctacttgaattcccaggagatggctagcagatttagaagtatatggcacacattttacaggagaggaagccccttaagagattttggcagagtgaggaaactgtccaagaaaggacccccaaagggatagagggaagagaggctgccaagcacggctgggaataaagcctgctcccagcagccagactggaaaaagactcataagtcccagagattgggataagtgttcaggagagatttcaaaagtgaaaaattaattgcatggcctgggcaccatttcagaatgcccaactacttttccgggtcctaaaagacctagaaacagctaactaacccaattacttaactacatagtagaatggagcccacggcagtttgaaagaatccaaacatttccatcatccaacaagataactttcagaaagtctgtctggactctaatcagaggcaatgtgcaggccaagaaagaaaacttaaccctcaatccagaaaagggctggctagttacaaccagcttagaactggccccagtgctagaattagcatcagcttgaaataaaactggtgaggaatctccaacccaggatttattgggaataatacacatgaggttgaactatagttctcacatacagaccagggctgtctcctgtgtctacagacagagggaaaggagttaggggcctatatcatgctcaaggacgatccgtagtccgtaaggctaagatttctttattcagataaacaccagccaaacgcaagccagagcgtgcccagaggcagcaagctagctaggccagagacaaggggtctccacgtgtctgaggccccttaagaattgcccctgcatcatcttcgacctcccctggccacgccttcatggcacacctgtaggggcttctaggaggcggggctacaatctttccctacaggggccaaagagtttatgggatgaactgttgctggctgggtcttatatagctagagttctgattggcaaatgttaattgtgggtaggcaggatttgaaattgaattctaatgagaaccctgtagtttcagaatgggggtgcaggagtcaagcaccctttgttcttttttggtcacccactgactctgtttcaattggatgtcacactttgtgttattagtttttgaagtgcaagggagacactgaaagtctgtcccagcaacattgtcaccctagctgaacactaaaaacagcatgttcatacagatgggaaaacagacttttaaaaagaaaaagagattctcaggctggagagaaccctcagtggtaagagcactggctgctctttcccaggatctggattccattcccaacacccacatggaaaccacctgtaattctagtcccttgggattcgacccccttttctggcctccacagacactgcatacatacggtgcatagaagttcatgcaggcaaagcagctatatgcataaataaaaataagtaaatcttaaaaaacacaaattctctaatgtgaagcagtgctaaggaatattaaactcttacagtggacgataagaggcagaatattaaaaagcacgttaccaccatcatagtggctcattacagtagttccaagacttgacaggaattgccatgactttgaggctaaactgggcttcaaagtgagatcctgtttcaaaataatagcaaagccaaacaacaccatccaattgcagttgaaatcctcaaacaggtaaaattcatagtgtttaagtctggttgtttctggagtatgggatcacagaggtaaagactacaagagggcattggggaaggtcagggattctctgtatcgacaagttgcaggcgtgtttgcagttataacagtggattgcactgtccagtttgtggaataggaattctcattagcattccaagaagccaataggaaaatcacacttcatgtagaagcagatccaatggcaatgttgagcagatgaaaacatgttcagtatcattaggattcttagtaacaagcagaatcacagccagaaaatattttatacctgccaaacttgtgatattttaaaactttaaggtatttttgacacctcttatcatgctgtgttgatgcaagataatatatagagtgatcatgttaggaaatattatggcttatctgtgccattaaatactccttccatgagtgtttccgtaaaaaatgacttgattattagagacgtggaatttatggaactatagacaaatggtagagtcaagtatgcatggggtacaactatcagaagtggaatttgatgaagctacataaaaacataggtaaatctcagggtgtaacgctgactgggaaaagctggtctccaaagactacctgcagaatgagttggtatctacctacctacctatctgccatctatcaatctaccatctatttggcaacatacaaaactgtatgaagtttacaggcttaaacatggtaacaataagaaaaagtggaaacaatgaacagaattaaatcatggaactagagaataatgcaaagatgtttgtttctttatttcttccctccttctcttctctgacctctttttcttcttcccctctgctttgatgatagggtctgagacaagcagcccagataggcttggtcttgcaatcttcctgcatcagtcttcctaatgttatattgctactctttacaccttatatattctctgcagaaattctttcttttccccttagtgtttcatatgagattaagtgaaagagtgaaaaaataatataggagagtcaaccaaagcttataaagtaaatatatatatatatatatatagcttgccagtgacaacttaaaaaccttcatgaaactcaatttaaacctgcctatttttaatagtgaaatgccctcatttagattgataagattatgctgtctaatggtagagctgaaagacacaaatgatgctattaatgaaataatgcatgaggtaaattcgaggagttatgaacatgttgctcattcccagatcataattaactgattacatgtggaggtgaggagcttgagtgtaaagacttctgccatttctctagagatgctcatttggccttctttacacagcagttcactacacgcagtggaactcatctcccttgctggacatttcaagtcatcagagggacggagggagtagctttgggtgggtggggtacccaacacagaatcctgcttccgagaacccaatatgtaagttgaaattttattccatgtcttctgaagactgatgtccccctggtacatttgtgtcctacatgccagtggtttctggaagaaacaacctgaatctgaaggatttattgcctataaaaggagggaaattccattctgaatttttggtcttttgcaagaccacagtggtcatggacagatctatttagacttaggagtctgcctctgactgagtggctgagtctcagctcataagcaatggagagaaaaaaacagacactattctgggttgtctaaaactgcttccaaaattacacaatgcaagtctgaggatgtggctcagctgatagacagcttgcctagtatgcttgaggccctggttccagtcattggtacatgaattgggcttggcagcacaaacgtataatcctagtagttagaggcaacagggagatatgagttcaagccacccttggctacataaaaagttcaaggtcagcctgggatacatgagaccttgttttcaggaatagaggaagaaaggaaaggaagaaaggaaggaaggaaagaaaaaagaacaagctcctcctccaaggagctatgagcagttaatggtttatgggaggagtagagtcacagtccttagtgtgtatccactgtgaagctgcccttccacctatgtttatttaagtgactttaatgaaatgcagagggtcacaaaaggcatgaaatggggggcctgtggggtaaagagaggggtacagtgtgagtgggaggggaacaagaggataatggtgttgggatatcaaagtgtattattatttttaaaaatatttatttatttttattttatttgtgtcctggcctgcaggacgtcaacctggggcaagagagtcagggatagggaatggggacaagagacacagaaagaacgaccacaagacaggattctgatcaagtggcaaactttacttttctcaggctagcttatatagttagcagagcaggatatggggaggggcagaatgggttgtttgtgtaccaggtgttagtataggcaggatattaggaagccacaaagaggatgtttggcagggtaaagagttcatgagtaagaggtccaggaagggttgcctaggtgactgggcctgtgggtggaggactggatcaagttgtttcttttcttgagctgaggttctaaggagctgcaatgtaaaggttaatatacaactatgtggccagccaagcatgacctaggatctcatgccaagtcctgagatttggctcccaacatatttgcattggtattttgtctgtatgtatgtctgtgtgagagtgtcagatcttggagttacagacagttgtgagctgccatgtgggtgctggggattgaaccagagacctttggaaaagcagtcagtgctcttaactgctgagccatctctccagccccccaaagtgtattattatatgtatgtctctctgtatatggatggattatgaaggaacagtaaagattatgagtgttctgattatagaaaccaaatattttcttgtggaaattacagcaagattaggaaattagaaaagagcatctcttaaatgtcagacttgtttattgtctctatccagctacccccaggatcaggaagcaggagatggggaggtaggttctgccttaggctggggaagaaacaattataatagaagaggttctgagagtccaggatggggagtggtggtggtggtggtggtggtgtgtgtgtgtgtgtgtgtgtgtgtatgggggggcagatgttgaaaatcttgtgtcagcctccttcactgctcattcaatgcagccttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtttgtgtgtgtgtgtgtgtgtgtgtgtgtgtgtgtgtgtgtgtgtgtgtgtgtgtgtgtaaacactctatgaaaaatgtctccagtaatcccaatttgaacttttttttttagttttccccatttttctcttttctttgattctaacctgtatgctttctctgtatttgtttactgataattattttagtgtacttgccactaaagaaatggggtggagagaagaggaaaagggaggaaatgagcccgcactagtggagttcacatctggacccagattagtgtttgcctaggtcagcatttatttatcttttcactaaacttttctatccaatcataagctaaaagtgctttccaggcaagtggacataagatgaccagcgacactgatggagttacagaaggtaaccagaagatgggacactggccatgtaggaggtcattcctttgacaaaatggaaaatctatattcctttttggtgtgtgtgtgtgtgtgtgtgtgtgtgtgtgtgtgtgtgcatgcctgtgtgtacatccaactgtgcatgtgccatagtgtggagctcagaagtcaacttcaggaattggttctgtcctaccacatgggtcctagggatcacactcaagcccttaagcttggcggcagatggatgcccttaccttgcaaagccatctggctggctcaagacagcattcccagaacaatggctgcagatcttatgagacactgtggtagtaacaagaggcatatttaattcatagtaagtccagttgttcattgagtaaacttaaaggcacaatattgaaccttgcggtcctgaaaattcacacaggaagtggctgtgaagcttttccactggtcagtaattacacagagcacagtgttgaccctttactcgagaaccaccccctacatatatattctgactggcttaaaaatttctgtaggtaaaaaattatagttaaaagctgtcacatttttcaggaagaatatggacaagctaaaggctttcttaatgatgtcttgcatagagctgtgtccatgaagatgggtttcctgtgagcaagccatacaaatctttaatatgttttgtatttgcactaaacatcatggtaatttataaataagttaggaaatggatatcagttaaaaaaaatcaccctaagcagaaatttctacaaagaaacttaccctaggagatagctcacatctataaaccaacatttgtctgaggcaagatcagagaccagcttgggtgatgagggatgtccttctgtatatatgtttctcttattggttgatgaataaaaacattgtttggccagtagaggcaggaagataggtgggactaggagatgaggagaattctgggaaaggtaggcaggagagctgccagggagacgccatgtagagaccaggaaaataggatgcaccaggcattctccggtaagccaagaccacatggaaatacatagatttatagaaatgggttaataattaagatagagctagctaataagaagtcttagtttaataactaatacagtgtctgtgtgcttatttgggcctgaagtggcaacgggacctggtgggacaaaagaaaactccagcaacacctgggctccatgctgagttggaggccatctgtgcctatagaatgaaactgtgtctaaacaaacaaacagctattttctttgatactgcactgactggttaaatggccatttcttgaagatttgaggaattctgaactctgaaaaccttactaaaatgaacctctgacatcttataatattgaaatattagctcttttattaattcacaattttgttatgtcccctttcatttgtaaattattgattcacttagttatgcaaattccctgaatgataaatcatttcattacataataggagaaattatgttcattagcactcaatctatgttgccaaaaaagtttttaggattgggaaattcttagtacaggagcagattccatgattctaattttcggttgaaaggacaaattttgcctttggcaatgaatactatcagttgttttcttctaagtgaaaactcccttcagtcatcttcttagaaaacattaccagatctaaaacagcctggtccacatagtaaattccaggtgagctagtgaggctgttactcaaaacaaaacaaaacaaaaaacaaaaacaaacagacaaacaaaaaacaaacctaaccccaactaatagtgtctgactaaaatcaacatgcaacgcatagctagactgccagctaagctttcaagcaacagagtttcctggaaaaaaaggtgcaggatctgagctatcccagaatcccaggagtactttcctcagagatgccacctggcttgtgaaacagcaacacaagtgctgtatgcacacatttaattctacccgctgaaggttaaaagaaactactctagaggtagagatttaataaaaccaaccccctgcaggctctttttttcccttccatttattatgtatatagtgttctgcctgcatagatgcacacactccagcagagggcaccagatctcattacaggtggccgtgagccaccaggtggttgctgggaattgaactcaggacatctgtaagagcagccattgtcacccctgcaagttcttgacagtaaagacacatagtggttgttgttgacttggtttgggccaagagcagttttctccactattgctttttctcagtcatttcaggctcagcacagtgacaaaggcagatagcaccgtagacttttcattccgagaacccatttgtgatggtgattttgactgtcagcttgattggtctcagacatgcctgggacacagtgagggtcacctctgctttcagagagggctcatgaaatggtgatgtgtggatggcacccatcatgaatgtgggctgcgatcctggatttaataagggaaaatggacaaagccacctgaacacaattcttgttttaatgttttcctggtctgttgagatgtgagcaagcagccttctgctgcaggcaggggctagttctgcctccttgccatcactgatgtggtggactgtaaaccctgaactgtgaatcatccctcaagttgcttcttgttacataggtggtcgcagccataagaaaagacactcatgtagcattgaaaagctcttgtggacccccagtccccaggctctgaaggaccacactctagaaccgacgactgttttagaagggacagggatgcccactaattgagatttgtgtgggggactgagggttgctaagcagcagttcccaattaaggcccatcgaagtgatccaaggacatcagtggccaactactgtccataaattaacaggaatttgtgtcttagcatgtgatttatctggaagaggcttttagtgctgagttctggaagaagccaagaagaattttattacggtgatctattttaatattgagctcagttcagccatcaaagccattttcaataagctttcaggaaacacacggatgtctcttctctttagtcatgggctctggggctgcttcagaaaggaaataaatcctctgctaatgtttaggaactaacgatgatgacttcagcctccctaaaacttctctcaagctttgtagccttgacaaggaacagctctctgggaaagctctgcatgtttgcaggcttattttaaagcaaactaagattcagactggggcaaatcaattaacatgcagaatcttagcatcaggggaactttgtaggatgcaatcctgttttctattggttcttacaaacaaaggtaaagaagccaggaaggccacactaatacaaaccatgtatactagtttgcaatactccctgacatttctgtatcttctatgacaaaataagagaatttggatccctctagccagtaagatattcccatcattcacctctttctgcactgtctcagcatacactaggcttgtcgacaccccaggacaccaaagtctggcagaagccatcttcattccattctgctgaacaggtgtgtttttgtaaacgttgcaaaaacattgggtgtgtttggaactgaagatctggaaagggcctgaggaaataggaagtatattcagatggtggaactgtgtgtggaacaacacaaacttgttttgtggcaatgataacggttggtttgatgctaaacattgcttggaagttgctgcttcttcaggtctccacatcctcactttgctgccaccaaaggaccaagtttcagtagctgtagccaccatgaggtctacatgaaaggctggagtcatcgtagaacacaggaaaaggaagaattctacatattcttaaacaaagagcattcatacgagaaaggaataaaagagttgaggataaaagaagaggaactttgcaaaaataaaaaaaaagatagtgtggtctaaggaaagctgtaaaaagatgaggtccagttcagtggttaagctcttacttagcctgattgaagcttaatcttttacacagctacaaacaaaataatcagtaaataattggctggccctcccctctttagtccttcttccctttgacatctattcatttattaggtttaattttcatcaaggtattgaaaatggtggggtgtggagatattggaacatggctgtagattcttggatgcaccttcatggagaagcccggggtctgtctacttcctttaaactcccatgagcttgtggctgcctaagtcagtgtagtacggctgtagtgatggagtgataactaagacagcagtggccactgcactgtctcagaacatttgcttctgagaactgaggcactgtggaagaagcctgcacagcctacagcaccatgttagagataccataagtagccattctgcttcacagtccagatgtggcttcacaccggcatcctagccccagcgaaggatatgggagtgaccccccacccataaccagtcagtgtagccctccacaacacagccatagtagatggggttcagtcagacagtggagctgagaggatgcttccttggggtacctcttcggagttcctcacctccaccccaccccagaaactatgagcacagcatggtggttgttggctaaccccactgagatggttgattacttgtgatggaaaaccccactgatttatgagatggttgattacttgtgacggaaggtaggggtgagtagctggttctcagttagacaaacacaagcctacaacatcagatacttcctgtatctgatggttctgtcacctggtttgtacagtcggttcatcaaaggtcatggacacgtgagactgagatggtccaggaccagccatgggggaaagcaggcgaaaattcaccgatttcctctcaacactacctcgtgactgacgtcagtaactttgtcagcctcaggtaccacatttgccttgaaaactcagagctcatcttggatgttaaagcatgacaaggcagatcttgtggagatttttttcaaggtaaggtctgtgaaaacgcaacattaaaatgatccctaaaaagactacctaagcattctacggtaaaggtcacagtatttataggcctgcttcagtctcctgaattttaaataccctgtggttttaatttaatacccagcatgaagctgttctctgctctctaacctctcttaatgtcttgatttacttgactatgtaaaggtaattataagagactttttagagtcaccaagtgagaacccacttctcatccacatgggaagagaaatttaaccaaattgatggcgatttctatctaacttctgagagctgagctttgttctgtgggctgttctagccgccagcacctagcatggtgattggcatgtcataactatgcaagaagtgtttgttgatgaaacagaactgacactactgagtgggctactgaagaaaagagaagtatccacaaactcttagagttcattctttgagtaaagaattattttctataaattggcatggtgtcccatactggtaataccagcactaagaaagctgaggcaggaggattgcctagtagtttgaagtaatcttgggctatgtagtgaattccagggtggcttgaactacagagtgagatcctgtcctaagaaaacaaaataaaacaaaatgaaaaacatttactttttgcatattttggccactgcccagtgaaagtaaagtcagtcagaagaaagtatatgtaatatacatgtcaataggctggtggtattaccctgacacacttctgtaaccccgttatcatcaaggagggcagaggcaggaggatagaaagttttgggcaaatcagcctggattatgtagcaagactgtctaagatttcttgttgaattaactgagctttcaaatgtaggagggaaagctgtggccatgagcttagcattttggcgnnnnnnnnnnnnnnnnnnnnnnaaaatggccaccaaaggggtggcactattaggaggtgtgaccctgttggaggaagtgtgtcactgtgcaggcggactttgaggtctcatatatgcttatgataccacccagagttttaaaccacatcctgttgcctacaaagccaagatgtaggactctcagctccttctccagcaccatgtctgcctgcatgctgccatgtcccaccatgatgataatggactgaacctctgaactgtaattgagccacctcagtttaatgttttcctttataagagttgctgtggtcatggtgtctcttcatagcaatagaaactctaagacaacagaaacaacggcacagcacaatacagtgaaaaaacaaaattgattgaagttttattcatattctatatctgtgtatctaatatttccatcacttagaaaggcttttatcatttaacacaaaaaccaagttgcctataatctctaactaaaggaatggaactcagttgaaacccctttccttgtctggggatgtgtgcaaacatttgatttgtctcattcccaatacaagtgtttacaaggggctccccatcacaggtagatcccgtagttcaacaatagcacaatcctttcacaaaccttttcccagcctgcaggatgccatctattgtttacagagcacctgggaacacagcagcatgtccctggccctggtgaaacagacacaatgatgctgctggcttctgtggtactcaagtcctgccactgctcttttggtcctcatgccaaccatgtagggatggtgttatacttgccatcactattatccatatcctggagaagaggacactaagtggttaacttttgccaagtaacttgcccatgttttagtcactgttgtgtcactgtgaccaaacgcctgaaagaacaatttaaaggagggaagataaatctggctcatcatttcagaggtgtcaggctgttatggtggggatggagtgttggagaagagcagcttgcaccatgcagccaggaagcagaaagaggaaatagggaaggccagcacccaggaacacatccagagggacctacttcctccaacatggttccaacacctatcttttatcacttcccaataatgctatgatattatcattcaggggatcaatatattgactaggttagagctttcacaatccactaatctgcatgatttttagttcaatcatgttagcaattaaaaaaccatcatatcactcaatttcaaacatgtgataatagccaagattcaaaccctacccccctgacttcagattcagggttctcatcttggactgtattacttcttagacactttggtattcatgaccggtttatgctctccaaaagcatcaaaacaggctatagtaataattttatattagttcctttatccactaaaaataatagcttggggctagggagtctgcagtttaagagtacttgttgctcttgcagaagacctgtttacagttcccagcaccacatggtagctcacaaccatttgtaactccagttccaggggacctgacatcctcttctggccttggtgggcatcaggcatgcatgtggtacacatacatacatgcaggcgaaacactcatacagattaacatttttaaaagaaaagacagcttgcgtttcttttttttttagattttttttggaatttcacatcatgaaccccagtcccattcatctctcagtccctctatatgagcctttcacccttgtagcgtctctcctcaaaagacaataaaaaataagaatattaataaaaataaaaataaaaaacaaaccaaccaaacaaacaaaaaaccactttgttccttcgtctttcctacctttgcatcttgtcttcattcattcattttagtggcactgggagctgcggtgtgtcacacagtataccttttgttcaaacagctttacttgcaattcttctttgtaatgagttgttggtctggttcatgcctctggcttctggtatacaccatcaactggaacctcaccatgactcctctcggatatcctgctgttgccctgagtcatagagatcccgtggctatggtttcacaggaccagtcccttcatgtgctccagcaggtcatagatggggtaaatgctggggagggccaactcaaaccctggatgtgggtctggatggtagcttgggctggtcattcctggcctctgacatcttgcatttcaaatagagaaagcttccttccttgtaaatgtaacttgaaatatctctgacccatttttagcaaagctttggcatgctgttttcattattcaaactagcccaggggttatggatcatctttcaaacctgccgtgaatccacatgtattagagaagtaaccccatggaagtacatgaagaactttggggaaatgtttctttttgtggacacagaagtgatttccaagtaacttcctgtgtctgagcattaataaggagaccagtcacatgtacatagtgtgcaaagggcctgtccactctgtggagccccaactggaggcaatgatggggctgatggggaacagttgtggatttgggagtgagatagtgtgtcccagtcctgactttgccacttataaatcagctcttatgtggaaggtactaatgagcccccagactctcaggtgctttcagatacaatggccactgtagaatatctacctccaagtagatctgccagtattagtgcataaaaatataggttacctccctaaatttgaattccagataaacacagtatttaaagaaaataggagtgccttcaatgttgcatgtggcacaaactaaagttattgcatgagatacaagaaaatcttccattatctgaaattgaagtttattgggcatcctgtgttgtaggaagcacctctacccgaaagggctggtgtgatggctgaaagaaagaagtaacaggtaccaagtctagcccacttcctgcgcatgagagagagacaacatgtcgttctttctcctatagaagaaccttgtggtaccaagggtcctctcctggtctggacttgtcatctctcctcttaagagtttcctctcctatgactgagaaaatgttccttatgcaccgaatttaacataaagtattaaaattgggtatttctgacagctagcatttaatttctccctagtcttttgcaaatttatcaagtgaggtgatattttgtttatgatgaacaaataaagcttgcccgaaggtcagagtacaaaattagccacactagttaaccatagaggccagacagtggtgatagaaactttaatcccagcactcgggagacacaggcagatggatctctgtgagttcaaggccaccctgggctccacgagattgaatcttctaaaagagaaacagagctcacacaaaggtgatcccagcacttgggatcccatgcgtttaatcccagcactaggaaggaatataaggcaggagctcagcgcagtctgaagagcagttgagtcaggagcagtgtggggtttggtggattgccccttcggtctgagcattagtagaggtgagggctctctagtagccggctgctttgcttttctgatattcagcttgaaccccaatatctgtttcttgttttttattattcgtgctacaatagagtattttacatgtagctccaatgtgtatttattcttgcaacacttcccgctgcctgccacagtgctgggaagtggagcacagaagtgagtggtccctggggctggagagacggctcagctgttgaggacacacactgctcttgcagaggacctgagttcatttcccagcacccatatctcacaacctcaggagatccagcacctcgtctgggcactcatacatctgcctggcatacattctctctgtctctatctctgtctctctctctctctcacacacacaaagaaaaattttaaaaattataaagacatgggcagtgcctgaaggaatcttgcccttggtgttagtattcaggcgtctgtactggcgtccttggggtactgacaggatacgcccttagctgccgccacttagagcaccgcctgtgcacattcactacgttcccctttaaaagggccctgcccacttcccatccttctctctctctttctcttcctctctgactgttctcctctccctttgtctctccccctctttcctttctcctctcttctgctactcctgtctccagaggccagtctctctcccttttatgatccctttccctaataataataataaaaaaatccctctgcttgagccttgtttcatggcgtctttctcatgcatgccgcttttctacaacatttgcagtcaccacctccggcaggcagcattctgctgacgtcgctgtattcacgtgtgttacttgtgtgaccaagacccaatacaaaccagtgtaaggggagaagagtgtacaggctgccatggtgggaaggcatagcagcaggaatgtgaggctacttggtctcatgttagctgactacgaagctgggaaagaacagcaagtggaactggcctataaaaaacttccttcagtaaggttctgcctcttaatgaccacacagccttcgggaacagcgccacctgctggacaccaagtattcacacataagcctgtggggaatagttcatattaaacaagcatctggctactgatgcctctccccgtaccccacccttctggggaactacataaatcctcttctatttcttgcaaatcttgtgccttcttgagaattcatctgcacttaagtcatttcagcaaattcctctctagtctttttctctctatacagtcaagcctcacacccaggaatgttgcaattttttctctcccccattctatccattggtagataattttcactctataaagaaacggcacccttaagcttccattgtcccttccttcccacaacacaggacctttcccttctcattagtagcatagccacctgctgccagcttccttgattcaaacaaccgttgattattgtaataaaatgatacttatttagtgtgcctgttggtgtgtgactgtggaggtcagaggacaactggctggggtcgcttctctccttccaccatgtgggtcccagggattgaactcaagttgtcaggcttggcagcgagcacccccatggaaccatttattgatctttgattggacttttaaaaaaagcacatttactcatcactccaatatgtaaaaccccaaaatttaacaaacccaagacttctcattccactcagaaaaaaaccttcactggctttcaagactcttccttctcccatccctcgaccggctcactgccctcaaatttagagccctttggcagagacgtgcaggaccgactgcccactcacagggtgggggtgttggctgaggctttacctgctgaagtccacccagctggaccatcctcttttctgccacctcccattccacactccatcattgtctttctcattgggaaagggagccacgtcttgtctccatggttcaccaggatgtgtctggtcctagaacagtgctgggggagtcatggacattcattgtctatttgctgagctggagtgagtgtggatggttgcacaggcagacagagaatgtgagcaagacccagaaaagagagcatttgctgggactgaacagaaggtgagaattgaaatatccatggtatgaacagtttctgtggttattggaatattaacttgcctatgactgtacacctgagatttacaggatgctgctgaactcgggagtcaaagaaagcaaaaaacattacaaaaggctttgaaaaaccatctccttcctgttctgtcccctgggctccttctcatatctatgccataataaattcatataccaaacacaaagaacagggagggagcgcctctttcctccccacaaaactaagcacctgttctctatgcccagctggggctcttccatcagggaagcaggagcacatttgttgtcttattgaggcttcaagagtgtagctcagcactctgcagccagatgagggcttccagcagtgtttctggcttctagctacttattttttttttttaaatttgatcttagatgttgcagaaatggagcgacagaaaaaataggaagagaagtgctcatagtcacaaagaactggctcagggcttctcttttccaggtgtggaggacacacacacacacacacacacacacacacacacacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacacacactcacacacacacacactcacacacacacactcacactcacacacacactcactcacactcacactcacacacacgtgtgcacactcacatactcacacacacacactcacacacacacacacacacacacacaccccacatgcatgtatgcacatgattcatccccacacctcattagggccacattgagtatgggacatggggaaaccataaccatggttcctattataaaaaagggagggggtatcttgcctttttttttttttctttctagtggaggagcatgtgactgcatgcatgtttgcatgtgtgtggacacaagtgttgcaagtacacatggaggcctggattgacagcagaaatcttcctggattgtggctgccctgcaccatctgagtatcaggcaaaagcctggagatttggatgaacgacaaaacatccagtccttttttgagagaatgtctctcacctttattgtggagcagccttatatacaaacttacaaaaccccaggtcaaagggttcacaacaggatattgatcccagtggggtgaggtcaggaaaacaggaggtacctgtggttatgctggaaaacaactcttagagaccccgtggggactgagtcccaacactggatcacttattctttgaggcagagttggtcagtcaaactcagagctcactgatttggctagtcttgctagctagctagctttgggacccctggggtatgatttatttaacaatttatacatttttacttattggggacatggtaattgtgatgatttgagtaagaatcatccccattggctcatatatttgaatacttggtccctagttggtagaactgtttggaagggattaggaggtgtggctttgttggaggtagtgtgttgctgtagttttctttccatccaggtcctgctgcccttcagccccaaataaacacacagatgctatatcaattatgaaattgttggccaatggccagggcttcttattggctagctctctctaaattattaacccatatctgttaatgtaagtattgtcaccaggcagaggcttatctgcaatcctgcatgttactcctttggcagcatggtatctctactgagcctctcagattttttttaaagatttttttattatgtatacaacattctgcttccatgtatatctgcacaccagaaaagggcaccagatctcataatggatggttgtgagccaccgtgtggttgctgggaattgaactcaggacctctggaagaacagtcagtgctcttaacctctgagccatctctccagcccgagcctctcagattttatttattaaccaataagagaaacatatgtacagaacaacatcccccatcagaggtgtgtcactggggatgggctttaaggtctccaaagactcccatcatttccagtgtgctgtctgcctcctgctcacagagaggcactctcagttgttcctgattccatcataaactctcaccctctgaacccatacacccaattaaacaccttcttttataagttgccttggtcatagtggtctcttttttttcttcctagggtctcactgtatagctctggatggcctggaacttgctatgtagaccaggctggcatctgcctgtttctgcctctcaagtgctggaatgaaagacatggaccactgcatccagataatcatacttttatcacagcaacagaaagtaactaatagagtaataatgttgatccctagtttgaaaataagtcaaaccatactgcttcttatttgtgtctttatttacatgggatagggatggaaaaggacaaattcagagtgatggtgacttataagagaagggctggaacagtgagtgggaaaagagatttcaaatatacataatttttaaataaggtgagtgtgtcaagattattgaggactagtggcacatatttatagacttagcacttgggaggctgaggcagaagggcccagagttctaggtcagcttgggctacacattaagacaccatctaaaaaagatttgatgagtgtttggtggaaacagtggaaatggatataatcatttctttattctgttagggtctatcaaagctatattttcaaaagtagaagagaaggatggagttggataaaacagatttcatgccattcttgcagcctgagttaaatctagagagatttaattgctcccatgtggaaaagcatttggcatttttctttgatgttgttatattttgctatagcttgaattatgaaactaaagatgtttgagatgttccagggttcagatttgccatagggaaatggtctctttcactgtagtagtactttctcgttgggactgccagcctgcaaataatgatagaatgatttattatcaattataaaagcttggacttagcttaggcttgttcctcaccagtttttataacttaaattaatccatatttttaaatctatgttcttatgtgaggctcattacctcatctccatattgcccttcctagagttctctcacagactggaagtcctgcctagctattggccattcagctttttattacacggatcacagcaaagcatcttcacacagcgtataaataccccacagcatctctacatttctctctctctctctctttctctctctctctctctctccctttccctctctccgtgcgtgcgtgcgtgtgtgtgtgtgtgtgtgtgtgtgtgtgtgtgtgtgtgtgtgtgtggtgtgtgtgtgtgtgtgtgtgtgtgtttgtgtgtatgtatgcatgggtacattgcttccatcacatccccaaacatcatctgtgtaagaaaccaccccctaatatgttagaacaaaatgccaagcatttccctgggttctcagcgttgaatgaggaattccagcagggcacatggtgtacctgagtcttcactgggctgagagggacctcagctgggatgatgctcactgctgctcatgtttgtcttatttggtggatgatttatatctttaattttcttccttgctgcgctggtagcctgagtaaccaagggggttgtcctgctcaggtggctgtgatcattaagacaacctggatatctttccttattagcccagcttctccaactggctgacttgagcttccttcctgtctcaggatcattggatttcttccctggcatttatttcccctcaaagaaagtgttccagaaggcggagagtgcaaatcgctggtcccatcagacttgggcctggaactaccagtgaaacttttcatcatgttctgttagttggctggatcagagagaggggcagcccagataactactcttacaggtctgcctacaaggggagtctctacaggtttgtagccatcttgcttgcattttccaaggacatgtgattcctcaaacaccaacaccctttgatgtggtaggagcattgcatggtaagctaagcagcccaatctttgcagtctctcttcatggccttgtgttccttggatgggagccaggtgtgcctnnnnnnnnnnnnnnnnnnnnnnnnnnnnnnnnnnnnnnnnnnnnnnnnnnnnntgagagccacacagaaccaggtccagattctgaccccattcctcattacaggtgtcaccttaggttggtctttcctttttattaattaaaaattatttgatattttatacagttatttgcagttattctgaacatatctacccttctcaacttctctggtccttccctcacctttcccatttccttccctacttcatatcctcttttttttttttttttttttttgaatgttgtgaccgagtttatccattatgtgcacgagtgtagggccaatccactggagcatgggcaacctaccagtggctgtgttctcgaagaaaatgaaatggacttttcatctcttagcagccaacagctgcccaaaactccccagataggggtggggtctggtaagccctactccatccatgcaggtgtgttaagtgcttgcttgtgtgaaggcaaccacagctgttataagtttatggcctggataatttaattttaaagattaaacaaatattttaaatggtgtgtgtgtgtgtgtgtgtgtgtgtgtgtgtgtgtgtgtgtgtgcgtgtgacatgagctcaggtgtcctcagaagccagtagaggatgtcaaaccccttgtaattggagtgatatgaactgtctggtgtgggagctgggaaatgaactggggtcctctggaagaacaatgcttgttttgaacagctgggctatctctccagtctcctggctggttattcttgatgccccagtttcctctttgtgagatggaaatagacgcagcccctgtttggctggtgtgttgtaaggctagactggcatgtggccagcattcagtaatcacggtctgcccttcgccagtctccttgtcatctgtgtctggcattagatgacatcttgtgtgaacgcttccataagcagtgccatggttgtaaccagttactactgtgatgtgtctacctgctctgtctgactaggatgtgtttacaggtaggaatcgtgcctgtcctgttcttgggtttgcttgtccctaacgtcctgcagagtgctaggtacagactacacactgaaagagaataaatgagttaatgaatgaatgcatgaatatccccatatgtgaagctgtagggcatgagagcaaacagttttgaaaggcataggattgggtgctgggaattatggtttttcttagctataggacagcagctttgttcctttacagaaattctgctagcttattaggaaggtcagggaagggtattcagagaacaaaagagccaattatcctctttgagaaaagcatggctcagcagtgacaggatgaagaggagagaatctgctggaggagtcctgagaccagagggagatgagctgcaggacagctctgactgcactgtgtgcaggatgtgccaacacttaggctctttggtggtcagtgaggtgaagcaggaatgaggtggcataagaagcaagctagaagaaagaggggtctccaggcttttccccaaagctgaggcagctttgtgataactcaaatgggccaggactttggtgcctcctaattttgggacactaatccagtcttggcagtgacacccacacttgacatgaacacgtggaagtgccaaaggctccttgcacacatccatggggagctgtcagagccccaggctatgaagaatatccaaggatcacctgccaggcaggaagatgttcagaatgtcttgtccgggcttgttgtcactcagtagtannnnnnnnnnagtacacttgtcatcttcatatcaagaaccataaagacatagaacattttaaaaaaaagctctcagtttttttttaaaaggtgaattttttcatctgtcaaggcagagagtaaatttatcacagaaagaacgagttttaaaaaaagacggtaccgtataattgctgccattaagaacttcagtccgcttgtcaaatatctgatatttatgagtttgataggggaagaaaatctccatgtgtgtttaaacttctccacgtctcagttattattctccatgaagtacctccaggtacaactgaatatgcagagggttaatttttttcatgaaaatgggttgcaaaacttaaaacttctttaatttgaagctcctaagtgactaaaaattctagtcagcgtaatcattcattctaataggcttgatgactgctgtctttgacactggcgtgtgtgcctctcagtgccttctggtcacatggccctcctgccttggagtccacactaagggggaagcagagactgaacaggcaaagagcaatggcttctctgctgagaaggttctgcatgggcagtgaggaaaacattctgggatcctctcatcattacaaaaaccttatcagtgtgattatgacaaacacaagtataatttaccattacgtttcctgcaaaatacatctcttcttcccgattagaaatgtgaactgaggtcttattgattgagatagggtggcatgcttgtgccataggatgtatgcagactccaggggacaacttttgggaggccgtttggcccttccaccttgttttgaggcagtgtctctcctgtttttaccattctgcatagttcaggctgatctataggattccaggtgactctccttctcgtcctttcatctcatgtaggcatgctgggaatacaggtacattcccacacatctacctttttttttgttgttgttcatctaatcttattttatttttattatgtaaatgcttatttgtactcttttttctatttttaatttaaattagaaacaagattgttttacatgtcaatcccagttccctctctctcccctcctcccctgccccccactaacaccctgcctatcccataacctttctgttccccagggagggtgaggccttcttccatgggggatcttcagagtctgtcatatcctttgggatagggtctaggctctcccccatgtgtctaggctcagggagtatccctctatgtaggatgggatcccaaagtccattcctatgctagggataagtaccgacccactaccagaggccccatagatttcggaggcctcttcattgacattcataccacattcaggggtaaacagtcctatgctgatttcccagtcctatgcatggtctggggaccatgagctccccaatgttcaggccagctgtttctgtgggtttcaccagcctggaaacatacattcttcaaaatttgaaaatctaaaggaaatgcacaattttcagtagagattacaattaccaaaattaaatcaagaacagataagcaacttaaaaaaacatataaccccctaatgaaattgatgcagtcatcagaagtctcccaaccaaaaaaagcccaggaccagatggcttcatttcagaggacatttaaggtagcctttccactgggactaggatctgacgatgaggctttatatagggacaggccttacctgatgaaccatcttggtggctcccctgctagatacttaaaataagtctgtgtctttattttatctttttctctttttgcagtatttggatggagttaggagcctctcaccctctcatttcaaaatgtagttagttttactttgactctttcccactttctcagctctgtgcagctgcaaatgacttctgtcacatcccgcctgagaaagttattgcaggcagactcctttgctactgttaccttgctgcactgagttcctgtcaaccagcagctgagcccgatggaaaattttctggtcatgttacaaacagaaccttcttttctggtgggatccagcctgaactctgtcatgggtgatcactctcccagaggctacctgcagcctgaagctcccatgctgtctctcagggcattgaagtgagatggctacccatgtcctcttacatgtttggtttttttttgttgttgttgcttgtgttttgtaatgtctgtctctctgctgggtttttttttttttttttttttttttttttttttttttggtaacaactgtctccaagctgcagtaagcatgaatttccaactggagaactggagttaacaatgtatgtatcctcttcatcttttagatcaaattggcagcataattttaaaaagaagtgttttacattcatcatatataccgatattttaaggtaagatgtcactgtctctgctttaattgtactgcactctcttcatcctcatttatatgcacatcaagaggcttgctctttcttttaaaagaattacttcgtttccatgtatgtgtgtgggtctgtgcacatgactgtgattgtccaaggaggccagaaagcagcattggataccctagagctttgtgtgtgtgtgtgtgtaccccccacataatacaaatattctttctttttttcttccttccttccttccttccttccttccttccttccttccttccttcctttctttcctagaaagccccggcgactctcctgtttttatccttccacccccgttgctggggtaatgcacacacatagctgcacctggctttcatgtgggggctggggatctgaacttaggcatcgtgcacagcaatgctgaatgtttacaatgattcttaacctgagaaggattctcttctcttcctctctcttctctctctctctcttctctccctctttcttctctccctctcttctctctctctctctctctctctctctctctctctctctctctctctctctctttccatcccaactcagcatcttgcaattgctaggcaagaactctaccactgagctaaatctccaacccccagaagctacttcttaatatctaggatattttaccttcttttcccctgaaacaagtatttctgttcagtttccctcacagcatttcagctcactgtgaataagacttaaaaactcttattaatggctctgtttccaaacattataaatatgtatataaacttgagaattctaatttctcatagctataaggctttaaatgtcaaaaaattcaattaagactatcatgtcctgcattattaacagagttcatgaaaccactcatacacatacatgcatacacacactaaacaggttttgataattagatattaaatgtcgacaggcaccttggaggttgctgcttatgtctgaatagctcttacccattgcaagtgacattctgtttcctctttatagatttttcacacttaaaagggaagaattatgacacagtgaagactccttttggtatgccagaactcctagtgatttatcatcagaaattatcttcagttctgtgtccctgactgctcaattactttggtgagaacaaacagctggaactcacctgatacaaaatgatttatcaccccgagttatggattatatacagattttttaaagatttttatttttgttttaaagtgtgtgtgtgtgtgtgtgtgtgtgtatgtgtgtcaagtgcacctgagtgcaattggtggaagtggccagaagagggtgtcatatccccgggatctgaaatgacaggcagttatttggaagccacctggcacagtgctaggactgacctcaggccctttgcaaggggactcttaattgcatctctctctaaccatgggttagacctcacatgtctcctaaatgtgatgtgttgaggtttggtccccactgtgggggactgtccctcagtaggagcagctggactccaaaacttactttctttttctcattagggaagcagccttattccaccctccaataatgaggccaactgacagggtgacacctctgaaactgggagccaaagtaaatctttcctacttttagttgactttttttttttttttttttgctcattcatcacaatgatagaaactaagacattgtaccagtgttatttcctctccaaggttttggaaaacatatagacaggctttgtctcatctaaggacttttcgctgatgggctgcactcttttaaaggtattttgcttaatccaagaatttagaatcagctattaatgggaatatcatggtttatttgtcaagtactactttagatactttagaacgaaatggttgtggtatatatttgcacataatacaaatatttgttttaagtattaagatgtccaggtttaacttactcattttatgaatgatatctgccatttgacgtatttgacccaaatcagtcttctttatgaaataacagattagacttacttaatgtgatttcatatttttaattcaaataaggctatgaaacgtattcctctgagaactgtctcattcatagattcagggcagtcagacactagggaaaataccatatgccctatttccttttccacatcgtgtgctttgcatgtgtaagcctgtgtgcatgatttgcatgtgtaagcctgtgtgtgtgtgtgtgatttgcacatgtaagcctgtgtgtgtgtgtgtgtgatttgcaaatgtaagcctctgtgtgtgtgtgtgtgtgtgatttgcacatgtaagcctatgtgtgtgtgtatgtgatttgcaaatgtaagcctctgtgtgtgtgtgtgtgtgtgatttgcacatgtaagcctatgtgtgtgtgtatgtgatttgcaaatgtaagcctctgtgtgtgtgtgtgtgtgtgatttgcacatgtaagcctgtgtgtgtgtgtgtgtgtgtgtgtgtgtatgtgatttgcacatgtaagcctgtgtgtgcgtgtgcgtgtgcgtgtgcgtgtgcgtgtgtgtgtgtgtgtgtgtgtgtgtgtgtgtgtgatttgcacatgtaagcctgtgtgtgtgtgtgtgtgtgatttgcacatgtaagcctctgtgtgtatgtgtgtgatttgcacatctgagcctgtgtgtgtgtgtgtgtgtgtgtgtgtgtgtgtgtgtgtgtgtgtgtgtgatacagagaggcagacatgtggaggttcaattttgatggcgagaatcatccttgatgactgcatgttattcatcaagtcagggtctctaaatcaaacatagacctcatccatatggcgtctcttgctagggagtttgctgtgctgccttctgaggctggaatcacagctggaccaccatgccaacatggcatttatgtgggttccagggatttgaactccaatcctcacctttgtggggtaagcactttaaccactgagcaatcctcccagccctttctttctttctttctttctttctttctttctttctttctttctttctttctttctttctttctttcttcatttgttgcctgttcttcgagacttgttttcatgtagccaagactcatctcaagcttgctatgcagttgagggtgaacttgaaattccccgatcttcctgtttccacctcccaagtgcttggattgcaggcatcaaaccatcataaacgtccttctacacagcctcagtaaaattctgcatgggaattatgacttgtgtttgtaaagaatcctagagagaaagaactgtgttcatgggtgtgtttgacgacagactattttagaaagggcaggtgtgaattaaaaataaagggcctgagttcttaaaaaccattgtgccatgtgctccttggggaatctttgttcgacctgagggatgtgggtccccactacagctggcttgggttgcctacagttactgatgggacacttctgtccagtgcatcaccagaagggggctttagagccagagagcatctgcattataagagaacaccaatattttttttctacaattgactgggcttcataggcaataatgtggagtatatttgtgggtcaccttgttactcatcctgatgtgaagaataccaggctaactttcatagctctctatctacgcagctctacattgtaaagactatgaataaaaagcgggatgagagatggtaagaaacgatttgcagcaggaataatgtgtagacacacagatgctcatacgtgcttgccgctttgagcaccttggggcatcagctttcttcagtgaaagactacagctcttcacagttccgataataacgatgtttaataacttcaaaaacatgttcatcctgaatgctcaatggcagcaactgttatcactcacccagggagattgtcaagcaaacacacagtttattatttataaaagataaacaaaatattttagcagctttttaattcttgttcaccagctgttgttggattcaaggagagagagagagagagagagagagagagagagagagagagagagagagagagagagaattgatttaatttgtgcttatttctgagttcctcagtgtgaacaggatgggaaaaaaccccagtacagaacaacattttcaagctcatcatggtggtacactcctctaatcccagcactcatgaggtagaggcaggaggatcaggagttcaatgccagcttcactatgttgtgactttgaggccagcgaatgccacatgagactctgtatcattaccaccaccactaccccacataaagaagaaagacgctataaaagcaagttcatgatatctgaggacagctttgccacaggtgtacacgagctcaaaagacagtaggacacagaggatcatattgatggcataaaattagagatgattcttgcttgtcaaaaacatttagttttcatgcaaacaaactgtcaaaataactgagtctgcactagatatatatagagattgtaaatataattagaataccacaagggaagctgtgcaaaaatccattggttatagatcagttactcaatgaattagtaaaaagtgatttccaacatccagttagtctataatttgagtgggtctgattctggtttattcctcagttttggagaaatcactgcaaatacagttcaattgtagttcaggaagttttgatgttctggaaaaagtcaggagacctctacacctcaaagttttcagataaaggggctacacgctggcagtaaattatcaccatgctcaccctttgccatgaatcctacaaacagctccttggtactcatcccaccaaacctctgctgctcctctgctgtaccattagtcatccaatcaaggactagtgtcctcagcccattgaccaagaacgtgtgacacatcagtaaaaatcacaaggaatgtatttatcacagaactatcaaattaggagatctttaaaatcccagaaggttcttctatccataatcagatttgagctaattttgacacagacatgcttgtgctttattcttaaattagacaggatttggagaaccccatgaagctctagattccttaggaaggaaaattgtaccaacattgttgcctggttggaactaagtcttccgtgctaagccttgtgaactgccctttgacctagaacccaagaaaaggataaagactataatgggccaattagtagaaaataactcatttttcttcaatcctgcttgttaaaactccaatggaatgaactgcagatttgcttctgatctgaggctaccaacaggataattagaaattgtgtcaagtgatgacaaatgcaagtaaaatctcctttttttgatgagtggtaatgattcttaagttatgcaaatttaatattttaatgagcagaactttcgtacttagctttaatatagtaatgtcagtggcaaaggaaaagcatggaggtaggaatatttttattattgtcagtttttttgggaaatataccaaggaagtgtatttgctaaatcttttaatttcaaaattaaattctcagtaaaaatgtaagactttaaaaaggatagagaactaaagtttctctacactgggacccaggtgttgtgtggggtctcttgttgcagttatctgactctttatgggttttcatctttctctgcttttcagctgtgctaaaattccacaatttgcagaataagtaattctcatccacagaggttccaatgaattatgtccagtagaggtatgaaaaactattactgtgcttatatttgtgttattgagatttgtgtattcattttaccattcataattacttgtacatgaaggtatctgtcttcagattctcccttgaataatttgttggctggggaaataaaagtgtggatagattctcataaattactcttaagactattttgagctgggaatattattcagtggtaatgcacttgcctagcataaataaggccctaggttcaatttttgcattgcagtgtgtgtatgtgagagcatgtatttgtgcatgagcacgagcatgtgtgtgtgtgtgtgtgtgtgtgtgtgtgtgtgtgtgtgtgagtgagtgcgtgttaataatctgttttctgtggttagaaagctggttctagtgtttaagcatgaagatttttgtggttgtggatacttgagactctcatcatgttagaacacaattgttaaaattctcttgttggctcaaagggaagtcagctctactcaacaaatcatttattcatttcctcagtggttggctagtaccttaacattttccatctaagtatcaaaaaggtagtgttagttggatgtggtagtgtacacttgtcagcccagcacttagaaggtgtggcaggaggactgccccaagtttgagggaagcttgggctgcagtgtaagttctaagtcatctagggccgcagagtgagactttgtctcaaacaaacaaacaaacaaacaaacaacaacaacaaaaaaacaagagcaaggaaacaaataaaatgggccagtgtcactgagtctgtaaaccaaaaggggctatgatgtaagaattatgaatgtaaccctaatgaacctgtaatggggtatgggaggactagtgaaaaggtatctttccaataacgtccccaagtggtctctcttgattcagtagatctggaacattcatgcttcattggccagatcctctggggaagtgactcctggtggaattagcttcatacatgttagtttaatgtctgtcagaaagttcatctaatagttcacaagataaaatgattttccaacatggaaacatactttagaagccaaatcagcatggtgaggatgtgaactctgagaaccgaggaagaggtctccttccgcacagagtttccaggttccccctagcttactctttctcacagtctcattggttcatgatttcaataatccatccacaatagaaagatgtgtggattataaaacacctcataaatattagctattaattttagaaatttcctatgtgaaagattcctttacgtgcctgaactactttgattttctattgctgtaataaacaccattttatcccccaaaacaacttgggataaaaaggggtttatttgacttatgaggtacaagggacgtcagggcatgaactcaaagcaggaacccaaagacaggaactaaggcagagactatggaggaatgctgcttactggctttcgcccacctccctaaggatagccctgctccagtgggctgggccctcccacatcgttagtaattgagaaaatgttccacagacatgcccataggccaatctcccagggttttttttttttttgtatcaagttaacaaaaattgatcagtatagcacatcattcaccatttagaaaaaccttgactttcttcggtgggtatctgtgtgggcctttggtaagagctgggaaaattttaacctggctgctgtcaactgtggtagctactgtagcttgaattcccagaatacttttcctccctgtttgaacctgtcttgacctataaaagcatcagcttcctactgttcacgatgacaatgacacagcaggcacaatctatactgcctcagtttatttttggaaaagactatcagcattttcaataactttgtatctcatcgagaagaatatctttcacaaggcaagaatatttaatccccattcataggcccctgtgccttaatctgctcaaattcaggaagggatcttgatacattttgaagcccagtgcagtgatgcactcctgtgtcctagcacttgggaggtagaagcaggagaagcagaaattcaagccagcctgggttacacagtgaatttgaggccagcctgggctacacaagatcctgcctcaatgaacaaaccaatccttctgccctctaaggataccatttctgtagcaagagtttgatttctctcatctggtagtttttgatcctgatcatatatgtcctacaacaactaaaacattctcggaaacttctgaaagtctgatttttattaaaaatcattataatttaaaaaatcttggggctggagagatggctcagcggttaagagcactgcctgctcttccaaaggtcctgagttcaattcccagaaaccacatggtggctcacaaccatctgtaatgagatttggtgccgaacactgtacacataataaataaatctttaaaaaataaaaaaaatcttttctgagggcctggagagatggctcataggttaagaccactgggtgctcttccagaggtcttgagttcaatttccagcaaccacatgatggctcacaaccatctgtaatgagatctggtgtcctcttctggcctgcagggatacatgcagacagaatactgtatacataataaataaataaataaataaataaataaatcttttctgagtgagaataaaacataaaattctttaagtgtgtagatgatcaactcaaaactttccagcaatgtgaccatatacttcaaaataatatcaagttgccctttaaaaagatacctctctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatacattttctctaggtttttgttcataatgttttcttgctatgttctttgatgaaatctaaagtgttgggtcactttccaaggagcagtctaatgccccacccccacatgtaggttcacaagcactgtgtccatgtgcatcaggaggacagaggtcaatgtcaagtacctccacttaagtttctgagacaggttctctcattgaccctggagctcactgatttagcaaggctgagtatccagcaagctcccaggaatccactgatcattgcttcccaagcactgggacgatagacacgtttgttcacatccagctttttatgtgggtgctgggaatcaggtccccacatttgtacagcaagcactttaccctgagccacctcttctgccctgaacagtttactttttaacttttgactttagaattttcatgggcattttatagctgctgtgtaagagacacctgaagtaatctagatgaagctattctctctgctttgtaatggaaaatctcattcagaaaaacaacaggctgttatctgttaagcatttgtaaaacaaaataaaaatactcagcataattgaacttaaaaggagccagtcaggctactactgtggaatattcctgtttacttttcagctaggctgtcaatgttgtcttctaggtgatgcatatgattcagacgttaggtgagaactagtaagaagatgattgatttatttatgtgtttattgttttgtggtactggagatcaaactcagggactggtgtgtgctaggcaggcatggacatgctacacaccatggacggagaggaaatatgtgacagcctactactgcagccaagactgcagtgatcctggatctacagacctcaatctccacagagacaacagctcatcagaaaagcttcatctgctccttccaattctgtcttggtctccccttggagcatttgaatgcatgggcacacgcatgtgtacacacacacacacacacacacacacacacacacacacacacacactatcgatttccagaaagttcccttacaacagtgttcttttggctggagcaggggtgaacaggaaggctgttccctctgggcccgaagactggtatttgctgggatcctgtcattagcatccccactgtactgagtggccccagtcttgcaggggtttccaccctgtgacttgatgggtgacttgacaggactttccaggcctgggctgctaaaacctgagctcaggtcctggaaacaataaaagtgcattttcccaagacatttacctgcagaagagccgggaacataaaagcccattctgttatcctactctgagccttcttctcttagtctctggtagaggtggggctgtatcctgtcctgttaattaagggtgacatagaatgtcatctcagcagctgctgggctgctgcaagtgccggacaagaatccagtgacatctgacaagggacactgatttctagcaggagggaaccaggagaaccttttctgcagtgagtccctgagactggcccagaccctacacagtccagtgccgcccagtgctgtgatcagtgaggggcccctgaaatggggtcttttggaatcacaaagcaggaagggagcatgtctttgacccaagctcctcagagagtctgagggaannnnnnnnnnnnnnacctccaggattatcttggctccctagttggtgtggagtggccatctgtgagcctcatcttagccacagcgtgctggaccctgtctcacttaacaggcatgggattgtcacttgtgccttcccttgccatttcttcttggctgtcacagtaatcttgtaatcattcactccctggttcatcctgctgtttgcaactcttctgtatccccacacccttgtcctctttggatgcctgcaatcaaccacaaaggcatgtatttgagtaatgtttcactttgacagagtagatctcacatttgtcagctgaaggtttaaaaatcacaagccctagaccttggtaaatgtacatggctacctggctgatgacttagtgggggaagtctcagtgggggatgggggcatcgtgacaactgagacttcccaatgtcttatctgggggtgataattttgttctcccataggggttggaggaggacccttgctgtggggcaaggttagagcatttttcccacctgatgcatataagtgaacggggagagcatccagcttacccccacccgccaaatcttaggtgttggctggtggagacctgtccattattatcacaggaggtatgggactcactcagacagaaggttctctgaatatctggggcatggaacctacagtactatggctatgagcaggatccatggccatgccagcccatacagtcccagaagcatcagctatctggactgcaaatatccatgacatctatcattaagatgggacagaacttgagcatcaggttattctctaggtggttgtgacaaactcaagccaagagtgcctctgtcaactttttcagattgaataaatctttcaagtttcatggaaatgaaaacatcaaccatctttccaatgtacatggattttacttgatttggaaatatttagaattgtaatgagtttttttttttttttttttcccctccgagacagggtttctctatgtagctttggaggctgtcctggaactcgctctgtggagcagactggccttgaacttacagagatttgcctgcctctgcctctcaaatgctgggactaaaggtatgtgccactaccactgagcaattcttgcttacctatatggagggctgattttacatatattaataggagccactgttttttttccccatagcttccttactctgtagttaaagtgattgctattaatgaataagcagccaatcactgaagacactcatgggagcagtcatcaataaggaaggtaatgagaggaaatcagcatagggttatgcaggaatagtgtccaagcacaaattttattcagatttatcaggacttgcctgttaatccacagaagtgatccatacagcaaacaacaaaccaaccaccatctacttcctgaaaatgctagaaagaaagtagtttaagcacatccctcaccacagtaagcctggaagcaggtggaggttagagagtccaggtctatccaggaatactcaaactctagccccaagcctggatttcactccctggctttgacctcattactgccccaaagcatcacagtgttaaacactatctatttctaggtttcgagcaaccatagaagcccacatcaaggtggctaccttccctggccagacatgcagcatctgggctggtcaccagacaaggcagaactgatggaaggtattgtgtcccgaccttcaggacatcaacctggggcaagagagtcagggacagggaatggggacaagagatgcagaaagaacgaccacaagacaggattctgatcaagtggcaaactttacttttctcaggctagcttatatagtcagcagagcaggatatggggaggggcagaatgggttgtttgtgcaccaggtgttagtataggcaggatattaggaagccacaaagaggatgtttggcagggtaaagagttcatgagtaagaggtccagggagggttgcctaggtgactgctcctgtgggtggagaactggatcaaattgtttcttttcttgagctgaggttctaaggagctgctatgtaaaggttaactatgtggccagccaagcatgacctaggatctcatgccaagccctgagatttggctcccaacagtactggtcaggagccatgtgagcatctgctgaacatcatggttcttttccaaggagaacctctgatcacagggtgcagattctgtctcctttagccactggctggtctctacaggcattggtgttttctggatacactgctcccatgaaatgagtttcacatggtgccttttggcttaattagatgagtgaacatttccctgagctgcaccttggtttaataacaccttcttgcagccaacccaccattctcctttgcttctgaatttcactaatgagctattcactccattttccagatcattagtgagactgtcagaattctaactgggccagtaccagcacccatgggtgatgctgttgctctggcagcccacagtcaaattattgtccattcccattcaaactccctcatatcacaggcagttttattctctctctctctctctctctctctctctctctctctctcttctcttatgtctatcatctatctacctatctatcatctatctacctatctatatttatcaatcatttatctatctatcagtcatctgttaaatatctacctatctatcatctatcttttatcgcatagtatatttcagtagagtcgcaataacctaggctgacttcaaacttgctatgtaattgaggaaggccttgaacttttgatcttattgcctccacttcccaagggtaaggattacaggcatgtgttatcacacatggcttatgtggtgctgggtattgccagggctttgtgaatgctagtcaagaactctatcaaccaaattacatcctcatccagtctatgtactttacatgctacccccccattttttaaaagaagtaatatatgactgtatgttgcataatacgtgtatgcccttgaacgccagcctttcctgaatgctgacagcaggttcatttagtattcatttttgtctattgaagattagaaggatgattatatgcttcatctaaatgccatctcttctttagcccacactcttgactactggtataccttttttacttggtacaagctttaagcttcagcctctctccttggccagctcccagactgttttatgaatattagcaggtcactgggtggctaagaatttcatataaatggttcatatctagcattggaaaatctgaaagtttcatggagaaaattgagaactatttgctttgctctgctgattcccctcactcacaagataaatacaacattaattcggtggcttaaatgaaataatccattaggtgaggctgttttattatttgtagtttaaaattactaggtttttagccatgccactgtgaacatactatattatgtatcataattgtgcatgactttatttatgagataaataaatgaatggaaaaaaattactcagtttgcaggcaacactaacttaaggaactaccagctatgcatctctacaatgcaagccctttgatgtgaccatgaaacattctttttacagtctatggaaatatacttttcaacaacacaggaataatgtaagctgaatgcaaaattatatctgttatcattttgccatgcaaaaatatgaacttggacactaactgaaagaaaaacagaagcctgacttcttgaaaagtaactttgttaaagtattcttaatcttagattaatttcctctgacaccataaagcatttatgcagtttacttataagttctggatatagacttctaaaattatgatacagagagaaaactctgagcatcagtatcgtttaatgtgcccttggggaaggctctccttctgctatatgctaagtgctgtggctttttcctagcaaaccaataatcttttccatacaacaggctctctagactacctgcagaagcaccaagagctgagggtcatgtagttaaatgttatcgggggccagtgagccctttcagaatgctggtcatctcttctgtgactacatggtgtaatgagtctttctctgtcccacgaggcagctcccaaacaatgacatggagacttactattacttatgaaagcttggcagtagcttaggcttgtttttagctagcccttatgacttaaatcagctcatttatattaatctatgttctgccatgcagtattacctcctgtttcctccgtgtctggctggagactccacctttctttttctcagagtcctttcttccctggaagtccagtctagtctcttcttgcctagctattggttactcagctctttattaaaccaatcagaaggtgccttggcaaagaaacaatttcatagtgtaaacaaatattctgcagcaatgtggtccacgtgttcctttgcacactgatgctcagggacgtctccccatggcacaggaggtggtgccgtggctgtgggatgtggaaggagatgttgccccacagtgtgcccttgtgtagagtgggatggcacccggtatagaatggtgagaactgcaatgatgtctgtagagtggagcggttaggacatggaatcacaggtcctgcccattctgtgaggacaactttgaatgtatgatctatgtccccaagagtcagtttcatcatgggaaacatgagtactcaaagtctgttttgtgagctaatgattaagcagagaggaccatgcatacatgagctaggagtaagatataacagtcacactactcctcacacactttcttcatgcatgtcactgaaccctaaagtcctaactttaactgagatgcaccatggaaagcatccaaagagcattgctggctgtgattctggagtagttgatttctgcctcttaaaatagttaatctttactggccacttgattaaagaatcaccaggaagatacatctttggaagtgcctatgagaatgtttccagaaatatttaattgaactggggttccatgccaaatgtgggccacatcattccctggccaggagtcctggactgaaaaaaaggagaaagtgagttaagcaccagtgttcacctctcggcttcttgacagtaaatgcagcaatggccagcttcctcacactcctcctgccatgccttctccaccatgacgactgtattctctaaaactgtaacctaacttttcttaaattgcttcttgtcagacattttatcacagtaataaagcaagtgagtggtaagccttttaagagtagaatttaagtggagttctacttgggtgcttagtcaatgaggctggataccctaaaagtctgggactaaataggatctcctaggttatacctggtcccagtctggtgctaaagacctagaaggttcacaaccttgaaaaatgcatgtttttactcaagatgagcatagcttccatgaaaacaaggctacatctactgtctaacactagaagcattggcagcttcagggatcttggaagccttttcctcttagctagagcaatttctgtagcttgaggtatactgttaactactgatcaggttgctttctttctttctttctttctttctttttttttttttggtttttcaagacagggtttctctgtggctttggaggctgtcctagaactagctcttgtagaccaggctggtcttgaactcacagagatctgcctgcctctgcctcccgagtgctgggattaaaggcgtgtgccaccaccgcccagctctgatcaagtttcttgagttaaaaagttaaatgaaaattggacaacacacaggtaagtggatttcaaacagcattagcatttgcaagctatcagaggtgtttgtaccactacgctgaaaatttgtacctctttggtttgaggactgagatttctctagtgcctaactagagcactgtgttctaaggcccactgccaaccccactgtggggaagaaaaggagtggcagacagtgtaccatgtccaagtgtcatggttttgatttgaaatgtccctgaagcacatgtcagggacttgtctcagttgtgagatgatgggtttctgggaaatgattcggtcatgagggttttgatttatcaaggcatgaacttattgagggatttgtaatctgatggcacatttggtagaccggtgggaaagtgtatcttgtcctttgttccttcctctctctttctgtttcctggctgctacaaatggagcaacctctttttatcatgggttcttccctatgttctgctttgcatcaggtccaaagcaatggaaaaagctgactgtggactgaaaccctggaaaccctgagccaaagcaaaccttttctattttaagatgattttccctggtgttttgtcataattgactaacagatcaagtgttaaatgtttcttggaggcagagaggggctgctcagccaatctaagtctgagccaggctcagaactaccatggagggctgttgatttggatggtgagatggagttttaatattgctcactcaggaaagccagtgatctttgttgactcagagaacaacattccagtggctcaccaagagaatcctgaggggtgatgtctagtgttttattagatctatcatgtacatggtcaactaaggtcaaacataaagtccatttatgtgtgacagtcattttacagatccatttattattggaattacagttaacattgtaccctaaggaaaactggttgttagtcaaggacatgcccttattaggcagaattccaaggtgtacacagtgagaggactgttctgccgtgatgctgtctttagctagaaagagttcaatttgcaatgttatgagttgggtaattatcagagacaatattttattttcaaaagttaatagttaccatactgtgtgcaaaatccaagaagttgattataaaagcagttagtgataaatatctttatgttttaagggcaacatttgcattgagaatcacatctctgttttgcatttatagtaagtgaataaatctgctattgcaaattttccagacaatcgtagggagaccaagacgagttcagtcgttaatcacatcgtgaaactacacacagccaaaaaggaattaaaacccagcaaaccaaaataacacaactggaaagcatgaaacctgtccagtcaattattggatcctagtggtgtttgtctttctgacctccattttctgtaggggtcagaaggacaagtggaaagaaacaatgaaagaaacagaactctattcttagaaaaaaatgtattaagaatggagaaagtatattttatgtgttgaaattgttttgaaaattaagacaaaattatcattcacttagtgtaggaacagcattctgttattaaaaaaagacaaagaattgggtttttgacttaatgaaagcaaaaatttttactcctaagaatatgagaaatacaacaataaaatgctaggtgcggcataatttatcaaagtaacattgggtaattggcttgttttcaaagagtgcctgtcaccagagagctccagcgtgatagaaacacattctttctgttgttgggaagaatctgcagtgacacatttgggacttagaaacacagagatagaggagcccattgacatcagagttgtgttgctgcatctctaattcctttgaatcccagacgtttggggctctagaggaataaccccagaagacctttctgctttcattcttgatttcattttttttgctttcattcctaatcttcctggtaggagccgcaggaccacactgctctttacaggcttcagtgcctgtaaatattttggtgcaatgtctggtacatggtaaggactcaacacaagctgtgtgttactgctgcatttttcttggtcacacttggagtcaccagtctgggtgtggtgttgcattcctgtaagtccagcactagtgaggatgacctggaagtgttacaagttggagtccagcttgggctgcataccgagaccttgtttaataaaaagagaacaaggatcattaagtctcaagaggaggcagagttcttcatagctgtcccgtcaccctatcatttacagatataggaatgttgttggcataggcatggggcaggtaggttcagaactggaacctagattccccaactccaaggtctgcagtgtctctttgttctagaccacagacctttccccactctgtttcaacttgaggatgtgggggtcctctgtggagaactcagcgctcagcagcaagcctcactccaagtgcctgccaccactgaggccacatggatgcctcatgttacagatgagggcaatttatgtgctaaaatcttttcagttattacccactctctaatgggagagattaaagcaacttaaatgagctatattttatttaatacccatctcaccaggcatgtttttctaaccatgatttattatcccagtcctgacttactctgtggaggtagtgagatctctggggctgcagtaagatggttagaatgcttgtgagtggacttggagacgtatttggatgtttcctgtttccatttactgagccctgaaagaaaatccatgaattatctactcaataatcacagccccattagatgcagcttcccatttacaaggagacactaatcttgttttctcctcctttttttttttttttttgaggtgatatctcacactgtagaactcagtatgtagccaaggatagtcttgatcttgtgacaatcttccagcctcagcttcccataagtgtgagtgtgtaatcctgataagatgaggaagaaggggagggagagtgggggaaaggaaaagagaggataagaagtcggaaggaatgtaggaagatatggggaatctgggagaagaaaacaaagagggacacagaggaagagggagaggaatggaacgagacagagggggcagagaatgggaggtctctctgtgttaaagtaatcttacgtgatacgtgttttgtttcatctaaactcagggttcctcccaagaggcatacttggaataggaggctgttcatgggtgtgcttggcagtggtaggttggttttgatttattctgggttccatcacgttaagtaatggtcagacctctaacagggaaatgaattcattcacagttgccatcttggaaagtgtgtagagcttgggttgtcataaaaacttgaaggtgttttctgtgttggctttttcttgctcccctgattccatttctcattgtctgtttttagttcattcttccttcactttttctcacctcatttttaacagtaaacttcgatgttaaaactctctgaattgtcccccaaacaatacagcaatcacgactgtctcgttgtggttaccacaggtgaaactacaaacctcatttttatagaatgacagagcttagaactggaggggatttaagaccatggcagacagtttgccatctgaacaccctctgcgtgaagtggaactgaaatccttcctctcatgtgggcagaatcacagccccaaggtgcccgagagctgtaatgttcccttatttggaaacggagtgttacggtagtgatgagctaaagatgtagcattaggaagatggtcctgggttgtctagttgagctctgaatgcagtcatctgttctgttcgtatgtgtgtacgtatttgtaggtgtacacgtacacatatgtgtggggtacatgtgcacacttgtgaaccaggatgtagaggtgagaatgttgatgtcattcctcaggctctgttcacctctgatatatattttttttacaagtgtgtgtgtgtgtgtgtgtgtgtgtgtgtgtgtgcatgtaagtaagtgtgtatgtggggacatgcactataataggcacatggaagtcagaagaaaatttcagggagttgggttctctccatcctagaaggatactctgttgcatggaactgggttgttagactcagtggcaagtgtcttaacctgttgagccattcccttctgacagactctctctcactggcctggagctcacaaagaaagctatgctggctggccagcaaaccccaggtatcagctgtcttaccttcttagtactgaaccatatcaggaaaattttctttttcttttccttttttgatctattacatcttttaaaaattatttcttttatttttaacattataatcacatcatttccccttccctttcctcttccaagccctcccctccttgctctctttaaaatccatggcctcttttttcgttaattgctgttatatgcatgtatacacctatgttcctaaatataacacgctcagttggtgtagtgtaacttgtatatatgttttctggcagtttttatgtagtttctagggactgaactgaggtcctcatgtttacaaggcaagtcttttactgactgagccatctctacagccccgtgtgcgtttgtctaagagagggggagagagggagtctccacatggaaagaatagaaggtgccatggccacagcgatggaggcagaccaatatggaaggccatcaagggattccaccattctccaaaagctgagagatgctaggactggctctaccgaagtccctggaagggttgatgccgggtcaatgcctaaccccagtttttggcatcttttcagacttcttgtctccagctgtgtgagagaagaagcaagtctgctacacagctccaggtgtgtgggagtttgtcacagcagctctaggaactgagtacactctgaaaccgagttgtcttcctttagttagtttaaagtagttttatattttctggacacagggtctctgtaggagacataaatttaacatatcttacttcatttagcacctgtgatggttagctttaatgttaatttgacacaacctagaatttctcaggaagagtgtctcagtgacggattgtttaccatgggtgggtgtgtgggcatattttcggggattatcttaataagttaactaatgtgggaagaccttgtcagctgtgggtggcattatcccctaggcaggatctaggggttcctgaactgcataagagtagagaactgcataagtgttcattccctttctgctcttgactatgtgtgtatgaccaagtgtctcaagcccctgacactgtgacttccctacaatgatagactggcacctggaattgtgagataaaataagccctttctcccttaagtcactgtttgtcatggcattttatcacagcaacagaaaagaaacttggacagtgttttccttttacccaatggtgtcttttcatgaacaattactcttgacatagtgaaatccaatgtgttagacttttcatttcttgttggccctatttagaataactttaaaaacctattcttagatctaaaatccatgcacaactgatttctatgtgtagagtggaacttggggtctatggttcactgatcatctatttaaaatgtagtctttcccctcctatgctgtaattatatctttgttatgaaccaagtgattctgagaatcatttgggggatgtctaggaagtagatgctaagctggaattcagggtacaagattcatcgtgggaagaaaggtatacggaaaaaagtacagataaagcaggagctgttatatttgttccctgtgaacagaggaggctctgtgatagaaggcgctcagacacagtagagctgagacgattgtggccagttcagtgaagagctccggggcaaagacaccagttgggatagtcctgagctagagaagcagccagaccccagatgcccattgtggtgtccatggttggcacgttcaggaagagggtgccctgggcaatgctgtagagaccttgaagttgccattactcagactcctcacggtagtctagggagacctgagtgaaaaaggtaacactatggcttccatggttcagccttacattgctttctgtacagccaaacaccacagtccccacaggcttccccagagggtgctcagggtgaatgttgggaggctgaacaaggatctttattttgtgactctttgcaatgctgtgacctatactcaaggtcattactcttccattattccttcttaattgtcacctctgcaggtatggggggcttgcctggcattatgacccaaaaccttagtgagtcttaggagccaccacattcctccagcagggaatgcttcaattaggagaaaatagctacatgacagcaatgtaggtggtatttagcacataaaacacattagcttttagttgccatattcttctcagaccagggcttttgtgcatatccacttatggttacattgagcaagataagcaagtgggagtccagtgagtcactcagtgcacaaagtgttccacttgctttattgcataggacacactgtctcattctgatgatcaggccgattggccaagaggcttcctccatttttcaagggacagttccttaactatggcagtggttattggccagtgaatcctatgctttgttcctggtctgtagatggaaacctttaagtgatgggggatgtccttctgtatatatgtttctcttattggttaatgaataaaacactgaccaataggggcaggaagatagctgtggctaggagatgaggagaaataggcagagagggactgcaaagagctgttatgtagctggcaagggagtaacaagtctgggcattctccagtaagccaagaccacatgaaaatacatagattcatagaaatgggttaataattatgacagagctagccagtaagaagccctagtcattggccaacagtttaatagttaatatagcatctgtgtgtttatttggggccgagaagggtggcgggacctggtgggacaaagaaactccagtaacatttaagcatgcagggcttatggtttgggggacaggggctataaaattatccaagagggggtgaaggattattgaagtgggactgcttatgcttccactcattgtttcctgagtgtctgtgctcttccctttaggaattactgcagtgtcttgagctctctggagaagagctcttcctacctctgaggctaatgggtggacacaactgtagctgaaagcttctatgcattccacttagtcttgtagtcacttataagataatcactctgagcttaacattatttataattgtttggccaatggctcaggcatattactaaataactctcacatttaaattaacccattttaattaatctgtgtatcaacacatggctgtggcttactggtaatcctctggcatcttacttctccagcggatacctggcatctctctgactctgctttccttctctccatatctctgtttggatttcctgactggttctattctacctggctactgtccagatcagcttctttgttaaccaatggtaacaaaacacattcacagagagagaggcatcccacattacacaatgcttactgaaccaaatgctttggcatggcatgccaggatgccagcatgccccctggtcattgtctaccctggctttgaagagggccatggataaattctgtgctgtgtggaattggatatgtaggaaacctctgcacagtgatgttgctgaggttctgtgttcatcaaaagccaacagagagcaggaaccacagcctggcctcacccatagtcaatttctgctataggcctttccaagctgtcagcctgtggcatcctggtttggggctggagcagtgtccccacaacaaccaggagagctccaccaggccccagcctctttatatggaagatgcaggatggagccattttttcatccttatttttttgatgcatatttctcttattcagaggaaggcatgtgttacagaggccttcagactggtcagagggggaaggaaaaacaaattctgagaggtgcataagttgccttttagaagatggttgctctcttggtgtcttttgctttggttcaggtttggactgtaccccaaaggcacctgagatcttccagattgcttcacaggaggaccacgtagtctctggtcttaaatggggtggagtggcatctaggtttgaaatctttttcaggttgggggcagcttcaaggatgggaagaacaagacaccagcaggttcctcatcatggacagcctgaccatttgtgaagatgtacatcaaggcttgacagtcaccttggtgacacatgatccgtggctatatagtgagttccaggccagcctgaggtagagagtgaccctgtctaaaagcagacaaatataacccttaaaatatgcaaaattgcagaaggcagagatgaggaaccttcatggcttcccaacccaaatgagttataacacacttgctgaagggacagcagcccactggagcaagtggctctggcagcctttactctttccccccattccctctgccttgctaaaaaccgttagattacattcctaaagctagcaaccaaggtctagtccctaggctgacttctaaagtctgtctcccttctatttagaggcaatcctctgtcccttctggacaaatactcctgcccccttttccttgtccccttcccttcttccttacccccccatctcctttaccactgcatcccagcccattcaaacgcagacatccccctttcctcctcttaaaaccacacccgcaaggtcattttgctgctgttttctacctgagccagcaagcagtcactgtaacttttcttccctgcttaataaagaatctctctgtggaaacaggtgtttggatgtgatttgtgcctaatctggggtctaggagggagaccccacactctgctggggtccccttcatttgcagtggaaggagctgggccagcatctgcttagggctgttcacagcaaaatattcttcagaacagcactgtactgcctttgctgtggctgctcacaggtagttcaggataaagggttgtttactcagatacatggagcaacagatgctgggacaatggctaggttattaattgcatagtttgtctttacaaacaaagatgttcttagctctgttggtggtgttttgggcactggttgacttcaaggatcacatgttctgtttttagctaatgtgttttgtgtgctaaataccatctacattgctgttgtgtagccattctctcccagtggaagcattccctgctggagggaggatgaggctcttaagactcaggaagctcatgaaacttataagactcaggtatagtgcagagctcacaaagtcacaagcctgtccccgctcccccaatcaatgttataaaagctcctagtaaacagtggctaaaaaaaaaggctagtaaagtatcacccatgaggaggtgggctttttagggatgtagctgtttttgatcactcatactcttgtaagtaaccccaataagctctcaggttcatcaagctggacttgagtggaatgtttctttggtttgttgttggtgccttatctgagttaaagaggaaaaaccatacaacagttgcctagtaactcttgagcaagtatatgcctgtgatgaaactggtttgaagaccttgcacctactgttggctcagtgttgtctgtgcctagttctgttcacacattggagcaatgaatgtgattagaatgtggaataatgggccagacacactgtaaaagctaactgatccttttgtttctttcaaaattgaatgtcctactttaattgaaattgtattaaatgatcaggaaaatacccccaacccaaggtactttttaaatccttgtaaataattagttggatctgtgtaacagcttccttttattattattcaagactgcctttattgtatgtctaggacccactcttttctaattaactgctattatctttataagtaagaataaaagccgtagcttttactctaagattacaagaccctacatggtttaagaagtaagcacactttctcttacctatcatgttgttctaaatttgcattttcctcactcctcctttatattgtcagtgttttggatgtagaattctttgatgggtaacaaagaaagttagtattatattcttcaaaccagaaagacagagtgatgtgacctgcacgttatatttagagctattgaaatccaagcacagctatgctgtgggcagagttatttgtcacaagtaagtgtggatgttttggctgtgtgacctgccttggatcatgtgccaaggcagtggtaggaagccaatgtcacactcaggatacctgcagataactaacgctgagccagctgggtacagagaggctttacaaggacatgtgggcttggcatttgtgaagaacatattttcaaatctttaacctccattttcctacaactgcttgtgcatgtacctgtgattgtaaacttgtcctggttcctgttttcttttctcccacggtcaactttctttcaatttataagcaagagacacacctctcattaaaagtattgaactataagtgtgagaactgtggaggcccttcagcactggttctgaaatataggagtcaggacacccccttgcaccaagacagcagccacttagcacagctcagcggcccctgcccatgcttacttctgcacaagggaaggctcaggagtaggactttcaaccggaatcatcttcagtagtaatggattatattagagagttacttgttgtagggattcttagagataaaagttaattcaggatggatggctcaggcttgtcacagcaattattttggagacagaacaggaagagtccaaattcaaggtcaacttgggtcacagagcaagttcaagccaacctgtggcagcatagtgagatcctgtctcaaaataaacacgaagagagcttggaatgtagtacagtggtagagtccttgcctatcatgtgcatgatgctgtcgcagaagtgaaccgtacccggaataagggtatagttggttatttattaaaagagggaatcacttacatgagaaaccgataaccagatagcactccgtgaatccagtctcagcagcactctgagacccaactggaaccccgaagagagcagggagctccttctctcagccctttattcagccacctgtgcacacctgtggccacaccccaaatgggcgtggttatcggcacaggtgcgcagatctctccctacatgatgctgggtttgatctccagtaaaacacacacacacccctacctatcatctatccatccatccatccatccatccatccatccatccatccatccgtctttctttcttttcctccaacgagaaagcagtcttgtttgactacaactacaaagtctaaggacatttatcagttaagtcgatggtagctattgcccgtaaatcaggtgagttaatttacagctccaagactttggttaaaacacaaagaattttagctgggagacagtttctgtgactatctcatggtatctatagctcaagtttttttgaataaaggtcaggagaggttcagagacatacctcccttccctgaattgttcatagggtaaacagcttttagccaaaggatgagagaaataagcaccaggatttagttagatctcaacaagcccctggtggacttcaggagtggagaaggtgactaactctaagaatagggtagcaggttacttagcaagtggggtggattctagctatgtactttcaacaaaatggacagattgttgagctgttggcctatgtgtcaacaaatgcacacttggatataggtcaccgtgcagtactgggaggtatgtgagatggagagagtttaaagacttactatagtcccttcttttattctcattggttcacgaaagcaaccaataaagaaaaaaaattagagtaggtgcttcatgatttctttttgtagcaacaagtaaaaataacctgggatacaataataagtacttcatacccgcttcctgcaaacaagctctcaaatggtcagaacagcctgttacagtctgaacattcaatcttgaaaaatgagtgtgtcaaaaccaaacttctgaagtttacttggcggtggtggtgggggaggtcttggggaaagtgagtcttgaggttggagcttatttgtggcttaaaaaaagcttaaaaaagcttctggagctgcaatggcttagcagttaagagcacttgcttttgcagagaacctgtgttcagttccctgcacacacagaacatctcacaactatctataactccagatccagggaatataatgccttctttggaattccttggataccgggcacatacatggtgcaaatggatacaggcatacacataaaaaaggctataaagggttgtgaagacacaatgagaagatgttatccatgagaaagtagatcccaccacacactaaatctgatgggatcttgactatggacttctaagactccagaattttaagaaataatcactgtcatgtgtaagttgactaatctatggcattttattatagcaatgcaaatggatgaagataacaatccacaaccatcttattaagaggtataattttatatttaacaaaaatcataatgtatttatatatcacttgtaatgacaaccttaatctgtgataattttttaacactttatagccttttccataaagaaaactcaacttgtgtgtgtactttgatgtagagaaatgaaataataaaaaaatggatttcaagcatggaaaggacttatactaaaatagagtgatgttgagggacgttggttatgtggtatcttagttagggttactactgctgtgataaagccaaaacaacttggggaggaaagggtttgtctggtttacacttccatatcattatatacatcatcgaaggaagtcaaaccccaaactgggcaggaacctggaatcaggacctgatgcagaggccatggaggaatgcttactggcttgttttccatgccttgctcagcctgatttcttatagaccccaggactagcagcccacaatggctgggccccacacatcaatcactaattaagaaaatgttctacaagcactttctcaactgagactccctcctctcagatgactttagcatgtgtcaagttgacaaaaaactgtccagcaatatggattctaggaaaagagagaatataagatgaagttgtttacattcatataaatagaagagcaagggctttggttggtactctgtttagacaccactgtgtgtgcttgttaacagtagtctttttagtagtagtagaagtagtagtaggaggagtcttgagtagcctttactaaaataattttaaaaactgcgccataaatggaaaagcagaaagggttttatttaaagagatagcatgagacaggcaagagtgtagcaggttactttgaccagagtgcccaagagtactggctactgtttgaggctttcttttttttgggtctcaaagaagaagaaggggttggttgctaagtgcatatggttatctgttttgattgataaccttgggtcatgtaagcctcccttacaatgatcccaattttaacaatttgaatgcccaatcatgtataggcataaggtgattaaaaggagatttctcctaaaagttcactcagcaaacacagtttgccttactctcctgcatcccaaactggttcaggatgggttagcccctgcctctggttccagatatatcaactggatatttctgaatggaaagtggagggatatgtacacagctatgggcaggggaggagcccagtgacatggaggggttgtatagctgaagacagggaaggattttatgttgggaaagggacttgggtaacttaagccaagtctcaggtcaccaatctacactatgcttacccatctcacctaaaaagagttataccactgtttcatgttgttataccagcacctacagtccctacagcacttacagtggtggcctttcaatgaattgaatctaggatgaaaactttttttaaacttttatttatttacgatgtatacagtgttctgcctgcataccaggagagggcaccagatatcattatagatggttgtgagccaccatgtggtttcttgggaattgaactcaggacctctagtagagcagccagtgctcttaaccactgggccatctctccagcctctaagatgaaagctttaaaataccaattttaaaaagcaaaatctagcaaacagttaaaacattttgggaaatacatgaggagaaagttcaaagaagtgggggggggtgagtctaaatttgataaagtgtccagaggaatctgtgccaaagaaaagaaaacccttcaatatggattttattagcaccctaggactgctataatgaaccatcacatactgagttaccaaaaaaaaattgctaagtatatcaaactgcagatttgaaggctagaagtaagcaaacaaaataaaaaacatcactgtttatggaaccatattccctctgaaggtaccagagaggcaaatgtactatgcctggttcctcagctgcaaacaggcaggcaggcactccttggcttttagatttgatacttcaatcatgtagccacatctctgtgtctttcatcatcttatctctgtgaacatctgtatctagattttgtaaaggcactatcattaaaccagagcccaatttaaccatccttagtttaacttaattaagcctttaatggacccaatttaaaatattgtaatagtttgagatgcttagtgttagaacttcaccatgtattttgagggggactaacagttcgccctagaactttgattctaagttttccaaacaaatcgtcaatgaaaccaaccacatggagaatataaaatgctcagcatctaagcaaaagtaggaaattaatatatggaaaacagcagtcactgtggagatctgccattcaccccagatggaatgttagcaaaataaaactttgtggggagtaaaagaaaaaaaagaaagaaaatttgtgctaatagtgaggacaataactgggagaaagaaactggtctggcgaccagtttccctaggccaaactatgaagagggcaagcatgaaaccatagtaagctgggtaatatgatcacagactgagaatttagacggtctatgccatggagactgttctattactaaaatggcctttcatgacgcttccagcattcttgggcactaactgagaaggatccatggaaacacaatcaaagggcaaggaggtgtgagagttggagtctgactcagctaagcatgttagagaagacctttgtaggagggtgggagaggagaagaaaggaggtgaggcaatgtgtccaggaaattgaattacaccattaagtgagaaacaggaagactctttagagtagaccttgatcaaatttctgaggaggcagatgtgaaatagcacatcaacgtagcatgttgtaggtgaccaagcaatggaagcatgaaattaaactattatttttggtctttagagacagggccttgtactgcagccagatctctctagagctaacagtattcgttctgccttagcctcctagtgctaggataattaagtcaactgtaatgtatttatccacagatttattagataatcaacataaaccctgaatagcacttgtttaaaccttcagttaatcagatggtatttacaagccacacaaggacattcattgctttgggctccgtatccttggtttgaaagataccaacatactctgtgatttttataagtggttccatttaataccatgattaatgagatttttaaaaatatttacagacaataaagacaagtaggtcactgtagaataaccataaattcttctcttaccacaaagaagtgatgtttttattttcctagactttatgtttctgccagtctgtgcccttttctgtcctgcagaattcagtagaggtgaaaatgggctagaggtgtagcgctgtggtagagtgctcacttttcgtgtgcaagaccctgtgttcagttttcagcaccgtggggaagaaagaaaagaaaaataaggatgggacaagaatctttctacacctcttcctctctttgatccctggcagctccacatgaacaagctcagatctcctgctagaggatgagaagataaaggccacatgaagcaaagatggatggccctccatgagtcctcagacctgtgaagaagctagttgaagtcagcaattagtgatcttgcagcagcccaaagatgcaccagtgacccaggatgagatggaagagccagccacacagcagaacacagccgcagctgctgagccatgaaatgctgtgttaggaatatcctttatctttagttttagagctatcaagccgtgagtaaaagctcacaggtccatgaggctcaggataaaatcttgttcacaggcacacagctaactggtaccagaagcttatgaagacaaacatggtaggagactacctccctaactttactcatactcaagatgctcagttttacaagagctgatatggggagtttagaattttaaaaatacataggttatagtctgacatttatggtacagttatgttgtgtgacaaaacttttcctggggagatgcaacaaacacgtctactaaccccagataggaaacctcggcagaccaaagtatggataacaccaatgtacaacttgatgaaccatggattttattggggttatttacaggaatgtgggtgaggcttacttataggagaagaaatgactcaaagacagctgcatcaccacagccaaccccagcacagacagcagctcacaaagaggggaacctggagcacagtgcacagcctgcaggcagctcaacagtttggagagtgtcctttccaggtgcctcagctggtctaactctctttcaggcagctcatctggtttctacttcttccaggagctggtctggtctcagtctcctttacatcttggcatggatgagagggactctcaacctttattgtttaccctggcagggaggggcctggtgaatctggtcagtttcaggaattcctgaagctattttgagttgtttaccttcctgcttaaggagcttccctgtaggatggattgtttcaattttggaggaaactattacacaagttataaaagcttagattatccagaggaaaacataagagacttttctgattcagcagcacataaattctttcagttgttttcttactaccattttttttttatgtagtccatgctggcttcaagttgtgatcctgctgcctgagagcctgggattataggcttttacatttttcaaaccatttggagccagtaggatgatatatgtctgtaatcctagcattaggaggcagaggtagcaggattacaagtttgaagtatcattaaaaacaaggggaaaaaagccgggcagtggtggcgcatgcctttaatccctgcactggggaggcagaggcaggcagatctctgtgagtttgagaccagcctggtctacaagagctagttccaggacagcctccaaagccacagagaaactctgtcttgaaactccccgccccaaaaaaaaaaaaaaaaaaaaaaaaaaaaaaaccaagaaaaaatagaaattctaaatcataacttaataaaaagttacttatatctaatttggcctccttagattcactatgtagtccaggctaacctgaaacttatcaacttatcttcctgcttttttttttttttacctcctgggtgttttgggtacagacatgcatcaccactcttggtcaggttttaatctttcaagagtaggtaagttaggactagttaagaatttcttgttgctttcagagtttaatgcaattagaaatcctattttatttagagtgggagatttcagctaagagatgaagctgggggtggaggctggcctgcacaccttcaggaactggggctgagacagggctcagtgatcgtccatcccgaaacccttctctgctacaggctgctgcctttgcaagtgtgcgtgaaagaggtgatgaccggaggtgtcaccacagatgcccttgccctctcttgatgcagtggacaggaaagtgttgatgacagggcttttggggggagctttagcatcaagcggcccagcagatgggtaattgaacactcagttgtgcactgtttaaattgtctgtgacctcggggtctggcattaagcaaataacaatgaaatcagatggttgagcgaggctgtcctcataggtgatagggcccctgggtatttggagagcagctcggtcagccaagctgttcttgccatctttcagagcaattgcaacagatttgggcaattggccatttgcaaatcattggccgcacttttgacacctatttcctgaccataagttaatttggagagcaaagctggaacatttctcagacacagagagacagcagtaaatgatccagtggttagcactgaccacaaaatccaacctgatcatggctgatgggtttatctgagttaatgctatgttttatttactttcaatatgagttttaaaatctctctctctctctctctctctctctctctctctctctgtgtgtgtgtgtgtgtgtgtgtgtggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacccattcactggccttgtttttatttatttttagaacatatgatagccaatgtgatacaggacaatagcaggaagaggaggagagggtttggtgctaggtagcttctcatttttgatagtacagtaacattttatattcatgccccaaacactttttgacttttcagttaaaaaacaaaacaaaacaaaataccccaccacaatctggagttagaaccacatagcagattttaaattgtaatagtataaaaaactagatcatactagattaatatgaggagtagaagaatttggggcatgactatttagataacattaatcatagcattacatgctattgtgatttgaatgtgaagtgtccccacagacttatgtgtttgagcacatggtcccccgctggtggcgctgtttaggaagttgtgatctatcttgaagcagcttcagggtacagcctgcttactgaggaaagctgcctgttatctgtaggggagaacctccgtagttcttccagcaagaatgggggagggtcatttccagaaaaggaggggtgggccacttctgtaccatccacagtgttctggaaactctgataaatgggttcaaaatacagggggcatctactcagttgtttctccctactcatgtgtggtgttggcttgtggacttggcttggaggnnnnnnnnnnnnnnnnnnnnnnnnnnnngcagctccattcgtcctctgcagagagtgaagcctctgtgagggatcaagcattccttgtctctcacatctcagtgacgaacatcttggccatgagtgctcacatccctacttccacagcagtgtctgtcaaagcaacaacccgccaatcctatcatcctgtgtgatggttaatcttcattgccaacttgataaaacttggaatcacctaggagacacactttgagggtgcctgtggggatatttctagagaggtttagataaagagagaagaccctgaacgactgtgacactatcccataggttaggattctgggatgaataaaaagaagtaaggtgtaagtcaggcgttggtggcgcatgcctttaatccctgcactcgggaggcagaggcaggcggatctctatgagtttgagcccagcatggtctccagagtgagtgccaggataggctccaaagctttacagagaaatcctgttttgaaaaaccaaaaaaaaaaaaaaagaaagaaagaaagaagaagaagaagaagaagaagaagaagaagaagaagtaaggtgaacaccagcactcacctctctctgtttcctgactgtgggtgcaatgtgacaccaggagcctcatgcttcccccatcatgaaatgagttataccctcaaactgtgaaccaaaataagcccctctttccttaggttgctttggttatgtattttctcacagaaatgagacatgtaactaacacacttagtgactaatacacttagtgacttgtctttcctctgcatattgtagaaacccactaatgcattccctttcactatgtaccatcctatatgacccctgcagaaagctttcaaaattaggctccacaaggctttctgagatggcttcattttaccaaactttgtggtttggatcctcaacaggagaatctaaaatggaatttttcttgtctggtgcttttgaaagaatacccttgagatgaaggcctttatgcaccccattgatcagctattgactgttggctgctctaggaaagggcaaccttgacactatggtccttcagttgaagccatctgtcaaacgtctgccagcaatctggaatgatgcggagtggtgaccacagtgatggttcagcagcactgtactgaacagcccttcgctattcttcctaagttgcggctcccatgtgtggtaggtgaatggggaactgtattccagtgtcaccaacagccttttggaacaggataagaatagagcaagagagaaattgtcttggttaatttttttttgatagcttgacataagttagagttatcacagttgagaaactgcatccatcagatcgcctgtaggcaagtctgtagtgtattgtcttgattaatgattgatgtaggaggatccagttcactgtaagtagctccaccctgtgggctggaggtcctgggttgtataagaaggcaggctgagcaagtcaaagggagaaaccagtaagcagtgttcctccatggcttctgctttggttcctgcttcaatgttcttgccttgggtataaggccctgacttcccccagtaatggactatgggctatatgagagatataaagtaaaataaaccctttcctccctcaagtagcctttggtcatggtgttccattagagcaatagagacaaagctaaaacagagaaagaggatgtggaagagaaaaacagagctactccactgactaaaacaatgatctcaggccatttgaagtaaggagagctgtccccaccaccagttccccacagtagatactgccctgaagtctgtttctatgacaactaggatgaagacctcaaaagagacaacttgaggccacactgcactggggttattaatgagatggggaaacgattgtgtttgtcatgtctcatgatcacacagaggtaatttacagtttaagtctcagtgaaaaattgctatacctagagtactagcttctggctcataatgttatgtgcctacagtcccatgaatctccagagactgtgcacatgatttccaaggctttcttagagtccccatgccattccagtgtggagctccatttgcacaactacctgaagttcaattaatgtatgcaagcggggccatccacatcaaagggcactccttgccttggaacctttttgggtacctcagtggtgttgcagaatactgcccccattggagacttggtcagtgaagctccacagatgttgtgtttgaactccaaaggcaaattgttatgttattttaatacatacaattaaaatgaaagcacaactctagtagtccctttaactgaagaaggtataaattgtaggcattttaatgtgtgacgcgtcgtcaagaatgtcatgacgaagcagataagaagctaaaacatcagctgagaatttctttccccactacatccataaatagtaaccatttgacatggagaatcgaagtcagtcattatcgggaaaaattacttctgatctttttctttgcatggctgatttattctcctaccctgtcaagggaagacttttacctcaaaaatattcccccttttaaatttcccacttctttatcccccttgacaggaggatggcagcagctctatcgaatggcaacaagctgggatatgttgttaaattttaatcatcctcctgcccgtgaggctgataattgggcatggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccttctcctccttctccttctcctcctccttctcctcctcctcctcctccttcttttatttgttttgttttgttttgttttgttttttggttttttgagacagggtnnnnnnnnnnnnnnnnnnnnnnnnnnnnnnnnnnnnnnnnnnnnnnnnnnnnnnnnnnnnnnnnnnnnnnnnnnnnnnnnnccgcctgcctctgcctctgcctctgcctctgcctctgcctccccagtgctgggattaaaggcatgcgccaccaccagctggccaggccaatcttctttatcagaggcatttctcctctctcctctgccttgttctgtctggtaaagaccccttctttgtggtcctcaaaagctaggtgtagggaacaaggaagaggtcaatggaaactcagtgccgtgatcagctttgctgtgcatctgaaaatgccttttaaaaaaatcaagtctgttaatttgataaaaactgtctctcaatatccttctacttttctcactcacaaatggatgatagcaagtgttctctctgctggtccagccctgcacatttgaggtttccctatgagttagtgttctctgtggcttcggactcactggtccagtcacgctcttttaaactttttgtgtgaattagtgtcctctgtgtctaaagactgcctggtaattgtcacctacatggtttctgcttttcatcccatctctgtagaatttttcttttgcttccatttttgagctctgtcttaacaaacttctataatagtgacaggaattgcactgctggaacaggtcttacaaacatcaaaactcagtttccaattctttacttttaaaagaaaacttcggtaacagggtaatcaagagcattgggaacggctggtaatgtcattggtcaatgggacctcactggccaaaaactccaaaagaggcacccattcctggcatgggactttttgtttgttagcctatggtgcttagcagtggcattattattgtgttacagggtaacttcacttacactttctgtctgtctgtctgtctaatgtattatatgttatagaaagcttctgcagcagtaggcttcaatatgacttcatgaaaaagtgtgtgtgtgtgtgtgtgtgtgtgtgcgcgcgcgcgcttgagtgtgcatatgtgcatgcatgtacaccgtggtgcttgtatggatgtcaaaggagaatgttctggaatcagtgtcctcctttcactatggattctggtggttgaacctaggtcatttatggcttggcagtgtacatgttttctcactgagtcattttgatggccagtgttatcttcatgtctattctttgtttgtttgtttgtttgtttgtttcagacatggtttctctgtgaaacagtcctggctgtcctaggactcactctagaatctcactatatagccccatctggccttgagcttgcagcagtccactcacctttgccccttgagtacggggattacaagcatgaaccccataccctgatgatttcctttttttcttcatatgtatgtgtattcacattttgatgatcaacaccataggactcattgaaacagctcttggctcagcaaattcctggctgttgttattctttttttgtaggagcctgctttacaggctctttcagactccctcttttaacagtgtttactgagtgcctgttatgtgccatgtgccatcctttatggggagaataatcctgtattcataaatgagtctggtcttcctgtacggatgacactggatgaaacacacccagtggatctcagaagtccctgtttctgtgcccatacaagtcaggtagaccaagtcctgggtcagggctaggttgagaaaggtttcatgtatggcgtggaagtgaaatcttaaggactggagaattaaggaatgtcctgctttattgtcaggggtcttgtgctttgttgttttcccccaaagaggatatcctatagcttaactttcaaattgtttaatctcttaaagcaaatgaagatctttgtcctatgcaaaagtttgagaggctaagagtacttcggatggaagttggtgtcctgcagggacacagggacactaacttggtgagctaattctttaagattagcacatagaagaaagctctgactaaatcacctagtgctcataaggcgtgacattctctgctaaggaaatcactcacttgtccttgctctttcccgtttcaaatccctcctgtatactggactcacatggatagtcctgggcatcattaagctgctctctgtcaacaaggtgtgaagttgatgaataagtctccatgttaaactgatgtttgccaactcccttcactttaatatctcctcatgagagttcaggcctaattcacaaaagactctttgcataaggtctagacatggtcttgaccatgggtgccatgacagtgggtgtaattgtagatttttctggaaatattgtgccccactccctcctcccttctctgtgttcctaacagtcacttctcccatcttttcacgtctttgtttaaagatgtgagacttagattgccatgaatattttagtttccttttgaggtagaagttctcctgcctagttgtaggccttatgatgctgatgctaagcctactgtcacaacatggtgattcaggaaagcaatgatgatggatgctcaggagagagtaatttgtatctgtatttggttccatgggaggcagaaagcagctcaactgacaaaacctcctagcttattttctatcagtatatctaaactctgcaacttgatgaatacatacaaaagcttcctatgtttcttgtatgaacgatccctttatcattatggaaatccttatttgtggttccacctgtcatagttacctacagtcaactgccatctgggaatgctgacatttgtcttgactttttcaagagagagactatagtcctttttattacagttaattgttacaattcttcaaattttactattggttttaaaaattaactgtcaaaactttaagttgtattttatcattggtatgtatacagggctttgcacccagtaggtactgtcctctctggtttcaggtatccactggaggcttgtgctgtatctccagtaaagaggagggggactatggtaggtttctagaagttatttctcctttatgataaattttgtgtaatttaaccagcattcatcattttctgcttcctacgtgcaggtgcaatgtaaccagctgcctcaatttctcttacctcccaaccccagatgctagtaatcaccattctactcttggtgtctatgagttaaatattagattacatatacaagtgaaatcagtttgtcttttcatgtataccttatttcatttaacatagtgtcctctactttcatccaggatgtaataaatcacaggattttctttcctgaggctaaatagtatcccactataaacacagacaccatattttctttatctttatgtagagagctgcagaaaaccgcacccaaaagatggcgctggtttccgccttccgccagcccgacggcgagcgctctctgtggtaaacaactccaaatatggtagaggtcatgtatcctcttaattctgcttggagacaacctatcctggcgcgccacgtagggttaggtgattggtagatgtagactatatcaggccccgtctccctcggcctggggccgccgcctccattatacattgtacaaagcaaagaggttcccgattaaactgtgtttgaagaagattcctcggtgtggcgtctttcttgctggtcaagggtggacgccgcatctttatccatttaggttggttccacattatggctgttgtgaagtatttgcacataattggctaggatataggttagtatggtcattatgaaacacaatatggaaaataataattcattaaaaatggaaagaaaacctacaatgtggtccaatgatgatcctactgtgtggtatatatcagtgatggttgattttcatcgtttagctgggaagatttaaaatcaccatagaaagatctatgggcatgtctgagagtgtctccagagagttcaattgaaagaggaagacccaccctatacatgggccacaccatctcatggtgtagggttccaggctgaatataaaggagaaagcaagctgagttccactattcatcactttctatttcctgattataggtgcagtgtgaaatgctaccttgggtttgtgccaccatgcctcccctggcatgatgatgacattctctcaaactgaaccaaaaataaacctgtcccttatcaggttgcttcttgtcaggtattttagttatagaaacaagagaagaaactagcatagtattcaaaggagacaaaatcaatattctggtaagtatctgtgctctatgctttactgtagtgcatgagatgactgcagcatctacctcacttaactctgattctgtagctgtttgaactcctcagtgcttcattagctatctaaaggcaagtgccccagtgctttgtggtgtttctagtgttgatatggtgttgatgagtggtcattagtgattactgaatcaacatggctgccatggctacaggaaatacagtcaacatggcctccctgggctgcagaaaagggatcatcctttcctttatatgtgtgcaaatagatgtgtggttccacctggtaaatataaaacacaggtcaggaggtgttgtacttgtgcaacattattagtatggtcagcaaaggagaaaggggaggcacttgtttatgtaccaagagtattgtaacaacataaaccaaaatatgataatgactaatgtctccgttcattcgctaaagatcagctacttagtaattattgtatctccagtattctaacttcataaaacacctgggatatttctatgatctcatttcacagatagggaaagtaaaatataggaagtctagtgatcagcctgtgatcacatgacttctaagtggtagagctgaaatttgaacacacatagtctggtcacaagttcccaagtgcttttaactgctacgtgctggctttctcaagatgacatcagttaactgagtttaaatctctgagttttaaatactcttagtataatatgataataataataataataaataaataataaataataaaaagaggaagcacttaaatgcagtaggtctttcttgggatcaatacctactggataaacaactgtgtaatactacattgtgtaaatgtactgtgtttctttgtccattctttagttgagacatctaggttatttccagcttctggctgttatgaataaggctgctatggacatacttaagcaagtgtccttggggtaggatggagcgtctttggggtatatacccaagagtggtatagctggaccttgaagtagatcaattccaaattctctgaggaaccacttcttctaaggaactgagggaatactgatttccatagtggctggataagtttgcactcccaccagtcatggaggagtgttccccttgctccacatcctctccagcatgagttgtcacttgtgatattgttcttacccattctgacaggtgtaagatggaatctcaaagtagtttttatttgcatttccctgaggactaaggatgttgagcatttcttcaagtgtttctcagccatttgagaatcctctattgagaattctttgtttagatctgtgctccatttttaaaattggattatttggtttgttgatgtctagtttctatatatttcagatattagctctctaccagctgtggagttggtgaaaaccttttccatcctgtaggcagctattttatcctgttgacaatgccctttgctttacagtttcatgagatcacatttactaattgttgatcttacagcctgtgctactgctgttctgtttaggaagttgtatcctgtgccaatgctttcaaggctattccctattttctcttctgtctggttcagtatatctggttttatgttgagatctttggtccatttggacttgagttttgttcagggttataaatacagatctatttgccttcttctacatgctaacatccagttagactagcaccattgttgaagatgctatctttttgccattgtgcctttctggcctctttgtcaaaaatcaggtgtccataggtatggacatagatttgatttcattgatcaatgtgtctgtttttatgccaataccatgagatttttttttattactatagcattgttgtaccattgtgggagctcgattcctttacaattaggaatgatgatacctctagaagttcttttttgttcagtattgttttagctattttgggttttttgtttttttctatattaaattgagtattgtcctttcaaagtctataaagaattgtgttggaattttgatggggattgcattgagtctgtagattgcttttggttggatggccatttttattatgtaattgtactgactcatgaccgatctccatgggagatctttctactgtctgatatcttcttcaatttctttcttcaaagacttgaagttcttgtcatactagtctttaactttcttggttagggttaccccaaggtattttatattgtttgtgaccattgtgaatggttttgtttccctgatttctttctcagcccatttgtagataggagggctactgagttaatcttggatccagtcactttactgaagatgtttattatctgtagaagggtcgcttatgtattctatcctatcatcttcaaataatgatactttgacttcttcttttccagtttgaacccccttgatctcctttagttgtcttactgttctggctagaacttcaagtaccatattgaatagacatggagagagtggacaaccttgtcttgtttctgattttgatgtaattgttttgagtttttctccatttaatttgatattggctgtaaacttgctgaaattgcccttattatgcttaggcatatctactatatctctaacccctccaagacttttatcatgaagggatgttggattttgtcaaaggccttttcagcatttaatgagactatcatatttcttttcctttcagtttgcttatatggtagattacattgactgattttcctatgttgaaccatccctgtatctctgagataaagcctacttgatcatggtagataatctattttgatgtcttcttggatttggtttgcaagtattttgttgagtatttttgcatctatgttcctatggtctgggcattagggtaattatgatttcataaaataaatttggcaatattccttctgtttccattttgtggaataatttaaggagtattgtgtgctagtttgaatgtgattggcccccatgagctcatagggagtggcactattggagttgtggtcttgttgaagtgggtgtgtccttattgaacgaactgtgtcactgtggggcaggctttaaagtctcttctgcttaagtttccctcagtgtcagagtccatttcctaatgctttctgatcaagatgttgccagcaccatgtctgcctgcacactgtcacactccccaccatgatgataaaggactgaacctctgaactgtaagctgccacctcaattaaatgttttccttttgaagagttgctgtggccatggtgtctcttcacagcaatagaaaccctaacaaagacatattagtattaggtcttctttgaaagtctggtagaattctgagctacaactgtctgggccttttttcttttttctttctttacttttttttttttttggctcagagacttttaatgactgctcctatttcactagggattataggtctatttaaattggtgatctgatctttatttaacttcagtaagttattccaaccccacattgggtgtcaaaatattgtttgctttcctcttttggctctttgctctttgggttttttgtcttttgagggcctgacacccagctcccaaataaatcacacacagtgaggctttagcctcttttctttcttataaatgcccggccttagcttggcttctttcttgccagcttttcttaacctaaattatcccatctaccttttgcctctggactttttccttttcttacttctgtatgccttactttcactcttactccatggctgggtgggtagctaggtagctggcccctgacaccatcgtctccttgttttatcttgttcctccttcttctctttgttctctctattctctctgcctgccagccccaactaaccttttttctgcctcactattggccattcagtgctttattagaccatcacacattttaaacaggcaaagaatcacagcttcacagagttaaacaaatgcaacataaataaatgcaacacatctttacattgctaaacaaacactccagagcataaacaagtataacatacccactgcaacaaagccataccccctaatagtgccactccctgtgaacttaacagcaccaattacattcaaactaccacaaatacccttctcatggccacatcttacttgtattttctactaaattgtttgaacacaattatcatggttattttacagttcctgtctgactgataggtctaacagcaaaataaactatgggtctagctgtgttggctactttgctatttaaatatacccttttgttttgtgtgtgtgtgtgtgtgtgtgtgtgtgtgtgtgtgtgtatgtgtgtgtgtgtgtgtatgccaaaattacccttgaatattggaaactttatgtaaatcgtaaagccattccaaagaccatttatacctgtgctgtggctgggtgtgtttgtgctctttcaggtccactaagattgaaggtgtagcccacatggtggcattgcagggatgcgatggacttgtaggggcagggcctcacggggaggtccttggagggggggggatatgcctttnnnnnnnnnnnngggatatgcctttggaatgcaattctcagtggaggtctagagtctggaggtttttttgccctgatggagatgtaatccctgggctgctcctgttcctggttcctgatatttgccatgttgatgggggatgtccttctatgtatatgtgtttttcttattggttgatgaataaaacactgtttggccaatagaggcaggaagataagtgggactaggagacgaggagaattctgggaaaggtaggcagaaagggaggctgtgaagagatgccatgtagagactgggaggataggacgtgccaggcattctctggcaagataacaccatgtagaaatacatagatttatagaaatgggttaataattaagacagagctagctaataagaagccctagctattggccaacaattttataattaatatagtgtccatgtgtttgggatggaagtcgtgggacagaaacaccagcaataccacttcttattctctgaaagccctggggtgaggcagttaaggacagacctcttcaagtctgccctgtgtgtttggactttgagcctcatagaccatgagctacattttttttttttattgcaaaagtagctagtaccaaggatcttgttgatttacaagatcttgttggaatgttcacagggctcttgggtaggccatcagtggctaagcatggctannnnnnnnnnnnnnnnnnnnnnnnnnnnnnnnnnnnnnnnnnnnnnnnnnnncttggtgcgtggcatgtggcctgtgttctcacaaggctcttgacagcaccccaggtcttctggcctgaggcatgtctatttctcttgaccttattcctttctagcagtgtcactgcagatgagcctacgatgaaggcctctgagtttagagtaggctgtggtgaggtcctctgaatttcttgaaagaaatactcaatgaggaatggaatctggctgacctgcctgattgtaggagaagcaggaatgatgggatccataaaggactggcattgctcattttcttaaggatgtactactttcctttgaggattgtctttagggaatagaggctcaccggcttgtgtcagagagttctgcttggttgctctttgagtggttgggtggctaagcaagcctcctaaattccttcatagtgactgggttagatagatcctatctatctatctatctatctatctatctatctatctatctattctacttatctatctgtttatttaacatctatctgtccatctatctgtcatctatcatatacctatttatatcctgtcatcatctgtctatcatctatcatcatctgcctatctattatctatctatctatcttctatctatctatctatctatctatctatcttcatcatcatcatcttcatcatttgcctatctatcatctatcatctatctatttgtcatctatctatctatctatctatctatctatctatctatccatctatccatccatccataatctattatctctgtgtatataaaagactgtagttattccttttagttgaatccccagtgtgtatagtaaagcacggattcttttgatgtgttcagctgaatgcttgtttgaaactgggctgttgcttagacagaactcagcactgaaatgcctcatttcaataaactgcttcttggcttcatttagaaattatcactaaaagctcttccaaataaatcacatgtgaaggagataaaattcctttaactcatgagtagcatctggtagaggttctggctactgtttccttggctcatttttgcttcatgtggattggatgaggcttggcaatttttcatcactcatgtgagtttccgtcaatggaaaataaaccctttcccttctcagttgtaactaatcaactttaggcatctgcttcctaatatatcaccaggaacatgtattgaaagatatcctgtggggtatagctgcttctggttttgctgtaagtgtgccatgcctgtgtatgtgtgtgcatgtgcatgtttccttccttgttttcagtagattacaattctaaaaagtatcgattatttttatattgagaaaacacaggagacacatagtttcttccataagaacataactttaagccaagtagtaaatctttgcagtttcaaagaatttagaagccacattttttttcaacagaaagaaaataggactgtagatataagataatctcaaaatataaatattactttataatccatcaatattcaccacgactcataaacatcaacctagtgatcagcatagtagtttttgtagatgattcaggctagcttgttatagtcaagatgatggtaaccattttgcatgtcattttttcttataaaagcctgaagtagacaatattcagagtagctatgagcatggatgaatttatcctgagcaggctgagttcttgtcctgcaatgttacttaccaggtagatactattgagtgaattgatgaagctctctgtgcctcaatttcttcacatatgcaaaggcagacacactactacctgtactttagaactactgtgaggaataagtgatgtaacataagaaaaccatagagatgacctggtatagaggcacaagggctgctgtaagggttcgggtttgaggttcctgtcttcatcctatggcagttgaggaactattgctgagaggtagtttctttttacagcatttcctgtttctttaggttaaggaaaatggtaaagtctcagcttgacatgtctatgatataaattatttgcgttcttgttatgggatcctagcattcaagaggaaacaaaaacagcttgaagaaataaaaggaatgctgtaccaggaaaacataaagcccagtgctgtttggaatcagatgctgtgtcaacatcggatcctcccagaagggtgtatttatctaatagatgaagatggattgaaaacatttgctgtgcttattctttttctatgatcaacacccttaaacatattgcttccttcatccctctcccttcctccttcctctcttcagtctctgcttatatagttggccttctattaatataacaaatatctggagtgatcacaaaggtttattgtggctcaaagtcttagagacagagttacaggcttcatagtgacattatcactcatgaccagctccatcgttttgggcctcagtggcacatttggggtggggtgtttatggagtaaaaccattttcctcatggcagaaaattgagcaagagagagaagaaagagcaggacctctccatccccgaagggcacgtacccagtgctagaagaaccttgtactagatcctgtctcttggagtttctaccacatttcagaaacactaagtaggggaccaattctttagtgtgtggggctttgggggacattccagatccatgtcataaatcactttgtttattaaaaagcccaaaccacacattttactaattttaaaattatcattattgttattgtatattattgtttgatgtgtgtgtgtgtgtgtgtggggggtgtgtgtggaggggcaggtggccatagcatgtgtgtggaggtcagaggtcaactttgtagagtttagttctctccttctaccttaacatggcttctgggggttgaacttggtttgtcaggcctgcaggataaatgcctttaccaactcagccatttcactcccttcatattttactaatttttagatagataaacattattttaatacaggaagtttttttgaggtaagttttgcaatgtcttatgcatgccacataccacagcctttgttatttatatacaagttgggaaatgcacgtagattttgaagtcaccctcagcatcagtttctactgtgagattttaaagatttaacctccaaagtattggtgaaatatttaaagaacacataaatccagacttctaggggaaggagacaattaaatttatcgtaatttgaaaaaaaataaaaccaaacagccatgtgtgttgatgtaatggcctggggccccagctgagcccaatcaattatcaatatgctttagctgttgatagaactttgtgtaactttaatctttatcagagattttcttcttatcttttagctttaagcaattttttttttttttttacttagaagtgtgaaaagaattgtaatctggggtttagttgtgacaatcatgtacattttagtttatatgattgtctgattttttttaatgtagaattttatctccactatagtttgcctcactccaacaattctttgctaagtcacccaatttataactttgaaaaaaatgaatgaacagcagagaaacattgagaccaagagtcacccttattcttgaaaccaagagctttacagtgtcgtaaggacctctcttctgactgatcttcacaaccacttcctagaaacttcaggacgtaggatgactcatggcctgttcttttgaaagccagcatcctagtgtaggtatttccttatttatgttgagttaaaagtatatgagatgttttaggtcggggaagaagagggcatgtctgttaggacctgactgtgactgtgtagcctcaggccagtggttctagtttttcatcttgaagatgacagcaatgaaaggccatttctgtttaagccaccatcactgttccttctggcattcctataaatttttttataaagctgcagagatgcagttctttgaaacattgctgttcttcccacagcaggtgagaactctgaggctctacttggtgttaggatctgggagggaatctttctccaacctagaatgttaaaagacagtcattgatcattcagtgaaaacccatctagttatcacttccttcctgtgtattagtgccttgcaagaaactaaaattctttcaaaattggcaagcaaaaactggagactcactggaaggatacaggagatcttacagagcctgaatgtgggtgtggggtactagtttgtagacagaacaagtggaaaagtctaactgattcatgctatgcctcctctaggccctgagaattctttttgtcttttgtctaggtggttttcatttccttttttttttttcaaagaccagctttcctattttgtgagagtggagtggcctctaacccagctttgcatggcttctctgagaaatgaagtacaggggctgggctgatgcctcagttgttctagactactccaaggagccatttctgtcacccatgaacatgaacacacacaagagactgattgcctggcatgggttagatggctgcttacacaatagtgggaaagagatcctaatacaaagtacaaagataaaaagtgtgtgcacagtgctgtgaggcacagcccacaggatctcatccaatgggggaagcttagctggagcagatcctaatagtcaactaaaggctccaggaagaaagtgcaccataactctcacgaggatggatgatttccagatgagtgagtgtggcagtggccactcaggctgagtcatggggaggtgcacaggtgccgagtggtggagggggctgaaggcagtgtcaaacctgatagtagatataacaggtcttattttggccaccaaccagctcccaaatcatgacatggatacttatcattagttatgaattcttgaccttatcttatgcttgtcccactagctcttaaaacttaaatcaacctgtttcttttcatctatgttttgcttcagggctttttacctttctttaatctgtatgtcctactctgtgtctgtctgtctgtctgtctgtctgtctgtctgtctgtctgtcagctgcctggctggctggccctggacatctctgtcttattctttttttcatctctttcttttctacctctatttattctctttgtctaccaaccctgcatatcccttctctgcagctattggctattcagctttttattagactaatcacgtgccttaggcaggcgaggtgaaccagcaacacccctttacatagttataaagtgatatcccacacagttaaagtaatattccagaacaagtggagggagctggaggcagtatcaaaagaactcttgtctttggcaacagttgtggttgcctttggcttctattcccatgtttttaaaaaagagttgtatctgtgttagaaagaatgtgatatttaaaaacagagattcaaaatattcaagccttttcatgctaatgataatactttttagaaaaaccataagagttttgagatttttaaaatcacatttgagtcctgcatgtttgcttgctgttgatagtctcaagtgagttcctttatatctatttgtatcttgaaggaatttaatatttaagaaatggcatcaggagcctttgtggtatgattgattttatgtcctgtgggatggagaaactgtgctattactcatacctcgtaattgatttaaggtttgaaaccttaattttcttctgaagaacatgaagattaatggaaacttttcttataatcatttctgaacatctacagctggatgcatttggctgaagggagtactgaccagtgaggtttgagacccgagttctaagggacatttgccctttcaacgtggataattagaaacaaaatgaacacacagctatgatgtcttatgctcctgctctcatacaggtattaaacacacattgctggtttccaaaatctatctttctttatcttgataattttaagattgaaatagcagcttatttatgatgataaagatgcatctggattcccttgcctgggggaagcaaacagggcatgtgtttcattggttcttctggggaagattagaacaaggaccatttattgatcatgcacccacctgcatccttcacatcattcttgagtacctggctgatctgtaacgcttagctaattgcatggtgtgggatttaactcctgcctgttgcatccaggcagctggcaaatgttgtgctagaacaggtgattaagtgattgcatgttcctggccaagaaaataagcagaagcaacacaaatacttttcttttccgcttgctccttcggaagttctgaaactcagtatctatgttttaagtcatgtggcaagcacagtgcagcattgggttgcatatactgtccaccatgaaataggttatgtcagtgtcatacaataatctttgtggagttgactagtttttctggaattggaggtcaccgagaagcttcatgtctagtaaatgtgtgacatcatctttcaactcaaaatttttgggttaactttttcatctctttatcattgttgggaagaaatatgctaaggagcatttatattaagactgaaaagtaatgcctctagctggcacacaccctgaaagccacacttgcctaggatatgcagagctcagggatattatatgatttgcttggcatcacactgagaaagtagggtgcttaggtatttgaacttagacccagatttcacaatgttgtcagccctatatttgttagattgaacccttgacagctgggatgttcagtagttgcaatgggtaatcctcctccatattgacaggccttagagccactgtggaagcacaactcatcagtgtgatggtgtttccagaaaggttaaacttaagaagaaagacccaccctgaacgtgggtggcacctttctactggttggaagaaggaagacctgccctggttgtgggcagcaccgtcctattgtttggaagaggaagaaggaagaacgtgggtggcaccatcctattggttggaagaaggaagacctgccctcatgtgggcggcaccatcctattggtttgagctctggatggactaaaaagggcaaagcctgctgagcaccagtgttcgtcttgctgtggttcacgattgtggctacagctacttctggctattatgctttccccacagggatgagtagtctctgacaaattgcaagacaaaagaagcccctccttccttaggttttttggtcaaatgtttttttgttttagtaataggaaaagtgtctaacaaggcaaccatggagagcattgtttgggtctatttttctcctcatcctgtgggtcctgggtggatttggcctctatccgacactcattagtcgctgataatttgctatagtctcactctcatcatcattgggttggagaacagtgagagtccacagtgcagggccttgggcttagcaatttccagaagctccattaaactccggagcaaaatgggaacttcatcgcactcctccttccctgtaaagtgctaactcactgaggaattaaatctgggtcctaatagcttatggattttttttttaaagatcattctgttcctctgggggagaaaaattacgtacaacttttgtgagggctggatcttttttttaaggttataattactttacaggcttttggccaggattttaaagtaaatgcatgtctgaacaagcattcagtgtgggtaaagtggtttaacagcagagttaaggtggtgaactggtatgtcgtgcgttaagctttctttaaaaaacaacaacaacaacaaaaacaacaaggcaggtaattcaagtgagagtaaagggtaaatatggcctggtatgcctcctgtttgaaatgaaatgtcctgagatcctatttttatatttatatgtttcttttaaattttttaccctagaacactatgttcctttttaaaccatattttaaaataattcttccattggtcaaattacccatcaaaaaagaggggaaaaagcacatataaatgacacaagtattcctcatgcctcgaaagaatgattttagacacttgcagtttctcttcctgtccccgcaggaagacagtgtgggtatctgtctctgtgaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtccttttttttactatgtctacaatctctttcttgctgctttcccccagtcttttgctttgcatgtcatctataaggtattgtttctgaaatttatctctaccttccatcttcttttactctgtgagataaatgtatttattccacagtatgatggttcatctttattgtcagcttgacttgatcacctgggagacgcacctctgggtctgcctctggcgtttgctgagatgtttaactgaagagggaagacgagctctgaatgttgggtgggaccatcacatggactggggtattggactgagtgaaaaggaaaaagtgagcttaatcctggcatccatacctctctgcttcttgatggcagatgtcatgtgggctgcctcacgtcatgactttcctaccacgataggctctaccaccaaccgacaaaccaaaaaacgaaccctccttaagttgcttttgtcagccatttcgtcacagtcatgcgaaagtcacacacccaacatccctttaaacatgttatcttgtgagaattttcttagtgtgcttgatatttttggggtaaattcatccacatttaaaaacattgtcatctcactgtagataattgtaacttttaggtggtcttataataatgaaaatgcacgaaacatttcattattgcaaatgcatttcacttggttgtggttattcaaggagttacagttctcattttttgtgttctcatttttaacattggattcattgttagtctggatccatattgtgaagaagttctttaaatgtctatgctttccgtcgggcgttggtggtgcacgcctttaatcccagcactcgggaggcagaggcaggcggatctctgtgagttcgaggccagcctggtctccagagcgagtgccaggataggttccaaagctaaatagagaaaccctgtctcaaaaaaccaaaaaaaaaaaacacaaacaaacaaacaaaaaaaacaagtctatgctttcaccttcaaaaggagtaaatcagtgtttgtcacagcaaccagacccctcagtagacgtgtcaacctctgttagttcaaatttcatcttttctaaaggacacttgcctttatagtactagcccatgagtatagctttgtgcattaactgcaccgataattctgtgtataatttggggtagtttcttttttttccccagctttatgagctgggacaatctctcctacattagcattggaaggggtgaatactgctcttctggtcatactgtcatgtggtcaccctgccagtggtgactttcagcatctagctcactttgtgagacatgcattcgagctatctgtgatttagcgctccttcactaacatcatattttttgccaggatgttttatgaaacttgaacatttctgtcagttgaatcacaaatatttatttgacactgatacaatactgaatttcaatgagaaaaatctcctagggtactggctggaaatggaagcagtaggacacacacaagcactctccccaccccatatttgcacccccaagttatgaacacatactatgtgtatgggtgcatattgtcttgatacccagattccatacttggtaacccgtttactccctatcatgctttttataaattttggattaataattgtggagttttcaggctactcttgggtagagcagagaaaaacttgagttgcctgacccaaatgttcccagaggaggttggacatggctatagtccagttcacctttgtgacttatttaattatgtatctatttatttttgaggcagatttactgtgtagcttaaggtggccttgaattttataattcttcatctcagattccttgctgatatgattataggcatgccaccacacctatctgctcactctgatttcttctttcaactctcacacttacaagtcctttttttctatatatatgcacacacacacacacacacacacacacacacgtgtgtgtgtgtgtgtgtgtgtgtgtgtgtgtgtatgtatgtatgtgtgtattgtgttttagtgtaatttttatgttttttctcatttttaaagtgttttgttttaatttttaatatttactctctatagtggattgaaagccttgggctaagttccctctggtgttcttaaacctgtgtctgtgttgggccttctgggtcagtccatgggttagggagccatcattaggaataataatgagtcaataatgcatctcctctcactggaggaagaagaaattactgttccatacaggaaaccaccaggaaagtcaaaacaaaacaaaaccaaaacaataacaacaacaacaacaacaaaaaaacaacatctgtaagttttgatgtggataaggaaaatattttaaatctagctgaatttgtgaatacctgaaataataatggataaaagtattatagacagcattgcttcaaggataaaagcaaagacacttcaacttcagccatgtgacccagggtctgtcaagtgcttagcccctgggccagcactggctgactcacacatcccccaaagctgtgccatatgatatgtgtgacacaggcatgcaaggaagattattcaaatcagaaatctgcagaaaatttccaaaggcagctgccaaggtgacgaagaagggtttcatggaggagtagtttttcagactgtgagagtatcttgtgttatgacgccatggagcacaaatgtcccccaaagcctctggttttaaatcattcaaaggctgtgaaacagattatttgtaataagtctatctttttgggtgacagaaacatacttaaaacaaggttatgcattgaaaagctgataaaagtggtgtgatcagagaattgcaaaagctgagcctcatacctcctagaggagcaatgaccctgaattcactaaagtagtgtatgtggtgaacttttgaagcttaaatacagcatctaccaagagctgatttattttttaaaaggtttatttttattattttgaaattatatgtgcatgtgtgtctgtgtgggtgcaggtatctctggaagccagaggcaccagacccccctggagttggagttgcaagtatttgtaagctacttgacatgcatgttgggaaccacactctggtcctctgaaagaacatcatacactcttaacccctgaaccatctctccagccctaagagacaacttcttgtcaaagtcttgaagggtttttttttttataattgtgcatccctaatagattatagttcacagcctgtagggaaaggagctggctgggaactcttgtctgggcacagggaatagtcttcaggcaaacatgttttcttctgaggggaaaacctcaggtttgttcctaaggtgtttcaacagagtgaatgaggctcaccttgattatcaagaataatttttcctgagacctccagggttcttgatcctgtgttaataatctcagaacatgacttggtgaatctgtttgtgtgagtttggtttctcagatgtatctggttcaattcacagcactagcttatttagggctagttaaaaacgtgcatttgtcccttttgtatacacatcctggacagggttagaattctcaccagcagaacattctattctaggtgttcagagctacatcagggccttgtgcctttttgccacagcatgattcttcagtgacatatagctgtgacttgtgtttctccaaggaccaacaaaaccgaatactgttttcaaatacttaatggacaaggaatatgtctactgtagctgaatgtcatgacatgtacctgggaaggctgaagcaggagaatcccaaatttgagccctttctggactgtatatagtttctgcttcaaaatcccaaagagacaaatacacatttattattattattattattattattattattattattattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattttttttttaaactagccctaaataagctaatgttgggacatgaaccaaatgcatctgagaaaccaagctcacacaaacagattcaccaaattatgttctgagattgttaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatctgattgaaagaaacagctattctaacggtctcagtggtagacagcagaacaagagaaaacagtaatgcaaattgctcctgaaaccaaagcaaaataaatttaaatagaaatcataaaaatccccacaacagcagtccattatgaatgtcatggggagcgtgtcacagttgaaaagattaattattcaattccttttgaattcagctggtaattgtttagttagaatctgaagtgttctgcaaagatgcatgcattgaatgaaggcttggcctggagccttggggtgaggtgttcctgggagggtgggaccttgaagagaatatcagaactctggcacttccttcttctgcttgttatttcctggctgctgggaggtacctaggcaggtttcctctgctcctcacacctgacatgatatggtgctttgccacaagcccaaaggcagcagggccatgccactgtggactggaacctctgccaccatgagcagaaatattttcctccttcaggctgatttgtctcactttgtactgttgatggaaagctaacacatggtttggaatgtcttgcttagtttgtaatttatggttttctcataatttatggatgcaggccacccgtctgctgactgacacaactccggtaggtgggaaagctagaaccagaaaggacagttatctgggctcagagtctgtgaccttgatacctcctccttagtcctgtcttccttgggcagctgtagacaggtagtctctggttactgtcactccccatctcctgctcctggcctggttaggcaatttgttctctctctctgtctctatctgtctgtctctctgtctctgtctccccctcccccacactgcccagcgcacctgtgctttctaactggtgcaatttccacccatctctatttttcctcattcataattttgtttgacacaaagcagtacatttgctgctgtttcttatacccaactcccatgactcgttgtaactttcttgacaatccatatcagttacagtttgcttgtttatcaatataacttggtaatttgtattctttcattatcaagctcccggagtggtggtggtagtgcttctttctttctttcctctccctctccttcttcttctcctcctcctcctccttcctcttccagcaattcttattctgcacatgttaaacttgataaataccaattagttgactaatttcataaaagaattacttgccaagaaagataatcttagaacctgaaacaacacacttgtaaaaactttcatgcgtgttgtgtagttgaaagccaagccatagcttggggatggtagggtaccaggtctccatcctctgaataatttcagtggaaagaagacaaatgaatgcaggttttatggccaaggaaaaaggtataaaagaccaaaagcaatgggtggaatgttctggagccctgttggaaatgagcatacttgtttggaaggcataggttagctgttgccatccttaaagcccccaagtacacagccaaggcaacagaaaaacctgtgctatgcacactgatcactattctgtttctctttttaatagcctttgtaataacccaaacttctataaatcatgatattactttattacctgactttattcaagtaaatgaaaataatttagccataaaattggtattagatttagagaatttcatttgtttccttccagtaattggagcacaaggaacaaatactcaaacattctatgcagccatgtaggtttaaatagttgcctagtttcattttattttttttttaattttaagaacttaatttttccttaatgtttaacatcatgtctgaggatgcatttccttcgtgtgtgtgtgtgtgtgtgtgtgtgtgtgtgtgtgtgtgtaggcatttatatgagtgtgtgtttgccagctttcctttccttcaacaaacacctgggatagttaagtttaaagagtaagaattttggttcattatttcagcggtgtctctacaattgattgacctatcattttaagcctgtgggaaggcaacccatcgcggtggaagcccatgtaaagtagaaccatcttcctcatgagatggaagcaagagagaaattaagaggaagaggccagagtgtcatgatcctacagggatgtgatcccggtgatgatgtcctcggacctcccaccaggctctacctcccaatagtgcccacctagagatcaagctatgaacacatgggcctttgggggaaacattatataaattagagatcagatcactgtatgtacctgaacttaactccagctccaggagatctgtcactctcttctggcttcggtgggtactggaacacacacacacatacacacacacacacacacacacacacacacagataaaattctaagggaagagtttgtcttggctttcagtttgagggtacagtccatcctggtgggggagggatagtgttaggtggctggagcaggaagtcaagagatcttatcacaactactcaactacacacacaaagcagagagtgaaaactttaagtggggtgaggctctaaactctaaaagtctacccccagtaaggccactattcctaaaggtcccacaacttcctgaaacgtcaccacaaactggggaccaactgtttaaatatatcagcccatctgggacattgcttaaaccaccacacttttccctgttacaatggactgtgtttattcaaaccatgaaccaaaagaaacgtttccttccctctagccaggcaggtatttggtcatagccatgagaaaaacaaggcgcacacatctttccattgcttgtcagagtcccacattgaaactgaactgctgtcaacaggggatgtgtgtggttaggctgtagagtacagggtttgcgataggaaacacctggaagagaaacagaagacacccagaaaatccagagctggcgtccttcccatacatggtcctatcttacagggaggtggggtaacagacatttctccaggctccacatggaaagagtgaatgtggggtgccacaaagctttaaacacagacactgccgcagaggaagaggagccagagggatttatggcaggcattcctgactttgaagaaagtgttttgcctgatgagaaaattaggtccggacagctcagtttggtgtgagcaatttcacagaagagcagctttagataatgttgatggattcagctctgatggagccggtaaacaaccatgagctctgtgatcacacatgtgggtacagacggaacaagaacttcctcatagcatcaagtcagctcccatggtcttccatcctggccaagaagagctgctatgactccttgtccagaagctgctggctgggccttgtcccactcctcagaagttcggccatggcaacattggctcctgtgccttctcttcccaatgccaactccaaccctgggagcaaacttttaatattggacacaggcgcccagggtttccttgtgtgagttctcctttgtagttagaagttagtgctcctggtaggtttcaaatgttgcctggggacactgggtaaaatgaaagggggctgttggctgatggggtataagaaagcaggtcaactaggagaaatggggtttatttgcaacagttcagtgtttggggctaagagtattaaataccgtaaacatatctcctgcatgtgatttaaatgaatttttcttttttatttatttcttttttatttttcgagacaaagctttatagaccaggctggcctcgaactcacagagatccgcctgcctctgcctcctgagtattgggattaaaggtgtgtgccaccaccgcttagccttgaattttactttttctaagcttgtataattaattaagtaaaaggaaagcataaaataaaaattatatattaaaagattatattatgaaataaccccaaaagttaaccatctgtgaaagttaaaatagctatatctagattattttttgtttgtaaaattaaaactggtttatggatatgtatttctaatttttgtgacgggtggaattgtggctttgttaaaaannnnnnnnnnnnnnnnnnnnnnnnnnnnnnnnnnnnnnnnnnnnnnnnnnnnnnnnnnnnnnnnttggcactgtggtgaacaatgaaacttaagggaagcaggggcatgacagtggtggggtcttttatacagagcagaaagattctctttgttctgtcaagtttcagggaaatcatttaaccaagtcccaaaagctgagcataatttattattatttaagcagaagtctatccatgatgaagcttatctttggcatcttactttttaaatcccctttaagcatcacagctaaaagaaaccgagataataattgtgaaaatttacagagttcactctatggaagccaccagggcaagtgcttcatggtttgcttcatcccaaagggacctgaagacgcaggtgtttctgaaggttttgcagggcctgagagttttgagaattttcttagggccatcctgctaggaattggaagattgagaactggtgttgctggcttggcataattggaacttgtgtgggacagagctttacagtctatgatgggcatctctcagcatggtgtttacaacagcagtccttgtgtccttggtaggtagctagatagggattgtagcctcagagggctttgaggatggacacctccctaatgaagtctacttctggccttgggtggacatgtgatgttctgatctgctccaaaaatgagaacattacatcctattatctcctcccttcagagtcaacccagctgggcctgtcaatcacctaccaggagtccatgccagggaagttagctgatttacttaaagccatgctaaggagaggggaggaatgattatctccttaatgagataatgtacttatccttcccagaaacccctcccttggggcagttgcctgctgagcttccatcttgtagaactgcatgctgcccacccatttcctgagttacccagaaaggcataacttttgcttttccaatctttaatatctttttctttctgatactggacaaagcctgaacttgctttccctgactctgaggtgtctcattctttttttctgaagctccctcccttctgccaagcagctaccatgcttattgatcaccagcactgaacctgcctgctttcttaagggcctccctttgactcttcctcttctctctctccttgaccattgccaagacttacagctggtctgctctggtgtttgtctcccagactctaacaaaattgttcttgacattcctaccaactctgttttaaaattcttttgtaaatgagactgacgcttccctcaaaggaactctgtttttcccttataacatatgcacccaatttgggggttcccagaaattttagaagcattctgagatgctcttaaagtctgcttttctgccaactgtggctgtactgctctgtgtggagggaaaaaatgcccagggttgtagaagagaggtcagtccagcctcagaggaggaaactccatatgtgagtgtaacacaataaataaaaagacccagagacagatattggggataaagcttcaagatgaagataagaaaagcaaagcagccactactagctctcacctctcagctcagaccaatggggtgatctgaaaactgctcccaatgtcactattcctcagattcactcagacttctatgctctccttaatgtggctagaaactaattctcagactgaatgcctctaccctttatacctctcaaatcctgggactaaaggtgtgagctttgattcattctccagtagcctagggtggtcttggactcaagagatccatctgcctttctcctgagtcctggaattaaaggtgtgtgccaccaccacctgatctctatagcttgaggcgggttttgcttactgaatcctcaggcaagctttaatgaatcataaataatatataaccacatctgagtgcacagttagtgccatcacttctttcatgtcggtcataagcagtgaacagtgtttaggacccctcttaacctgcaaacactttgccctctgtccttactgcaagttttccttcacaggattgtcccggaggttccagggaggggagctgccctgttcagccttttcatccccacatgctaggctcagaggcccaccctggaacctgtgactgacagggtcacccagctaccagttgcttcctttcaggtctcaggcatttccaatgtctggtattgtttcttctgtcctttgattctcatgccctgtcacagctgagtaggtcacggggtctagaagcagagccggatgctcatggtgacacaggatgccatttactttatgacttggaattcccacccccaaatataatactgctatgaagatccctggaacattttaacaaatcccccgtctctctcttaaagggcttctatgattgaaataagaaacccatgccatatgtctggtcaattctgaaaattcccaattctctaattgctctgttaatagttgtctataaatagaaagcgatgaaccctcttatgtctaatcctcccaaagcttcattctgatggttccctgttacgataaatctttctgccaaaagccgcccgagccctaccccccacatgtgcagtctccaccagctgcccgagttctgcccgccacgtggatggacaaaataatacagagacatattaggtacaaagctgcttggccaatgactaggatttctcatctgctagctcagtcttaattatcataaatctatatattttataagacttatcttattggactccttattggcgtccctcctagctggtggatcacattgctccggtggaggaagagtagaggggaaaagggacactttcggtttcctttgtttaaatatgagtctccttgctatgtcacttcctgcctggatcaccacttctctactacatttcccagaatcctctttgactcctagtcctgtctaacttgctgtctcatgggccaaacaatattttattcaataatcaataagataaacatacaaagaagcacattccccatcagttccctgagctactaagcatttaaagctccatttctgcagcacatgggtctgtatccaccatggaacacaggtttgcatgtgaagatcagtctaggtgggcaatgatgggtctttctgtcctggttcccttttgcttcaattatgcctgctataaataagtaatgcaacacattcttgcagtgtctagcttccatagcatggtgtgccaggatttccttgctgtgttttgacattttttgaaacttaattgaatttgacaaagttcagcattgcaatgttacacccctactggcccagcagagcctcctagaagactgtagtaaagagggcttgaggtcctgtaccgtgtttatgagcgggattggctcttaacaatactgaagcctagttgtgagtcatgaagatattcggatgtggtaatcttttagtttccaagtagaaacaatagctcctattttcatcatgatttttgtactgggactttagatgccctggcttcctttctgttcctgcttttatcacaagctattaacacttcatgatggtcctggtggaagttaaggctagtgtgctggatacttgacctggaatgaaactttaggattgttaaggatttgaagtacaatgtatcaaagattgttaaagctggtgaggggtgttaaaagggattcaaaaaaccctggtggggaactgttgtggaataatcttttttgtacactctgaagctggctcactcggattggtttaataaaaagctgaatggccaatagctaggcaggattgtttttgaattatgtcagaacccagtgtctactgaacagacagaagcaagaagagcaatctggggtgatttaacaagattggttatttcttcccccttcagcccacccttcctctgttccacccatctatccctggtagccctaggacaggcaatggcaattctaggcttgtgagtttgagtggtatctcctgataccacacaatgtgctcttctgtagtagggttgggcaaacacagtgtttgggcttcctcctccctttgggccagcacctgacagcttggtcaggctgtgggattctgagctggggctgggaagtgttggttcttgtcaatggtgtgggttatagtgggacttgtgtctttctgctggacagcctgttgtttgcattcagatctcattcttggaactgtcctttgcacatttaaatacaagaatgaattttgaactgactatttttaaaaaaattgggcccatatatttgaccttccaaaatctgtcttggttcatttctgaaaactttgaaatgctaagcaagaagaggcagaatatactgctgtacaatcttttcattataaaaaatcaaattagtatctttcaaaaagattgatcatatttttaattattaatatgtatatgcaaatgtccatggaagccaaggtgtcagaccccctggagctggaattacaggtgactctgagttgtctgaagtgggtgctgggaaccaaacttagttgtttttgagagcagtacagcctctttaaactctgagccctctctccaacccagtgactgttatctaaacaaatatgaaacttgggctatagatttggctcaggggtagggcccttgcatagtatgtacaaggctttttgagtttgcatcctggcattgaaaccatatacatccacttttcatagaaaagtcaaataattaagattttgggggaaagtcatcattttatagcatcccaacactcatccccatgaagtgtttttatgaaatagctacttaccaggggcccttcagttatgcttttcacgtacacagatcttatgagtttaaatgagaacttgacagagctacagctggctagaattttagagtcatttctgatagtcttgcctagcatttgtatctgatgtgttcaacttccactgtgtattttagttgttttaagtgttggatgtagtttataaacaaatgataagaaaacccatgataaattttacagggtttggaatggattcagcaaatacctctagtgtgtattccacccactacttctgtttcttcctgagaagtaccattatcttagattttatatttagttttcctttttatttatgattttaacacatatgtttatgtccttaagaatatattgtatgtttttgaaataagtatttggtttattttatttttaatcatatgcatgtgtgtgtctgtgaggggggtatacacacatgaaaatggtacccgtggagtgctcttaaccactgagccaactctccagtcctgtattgtatgtttttgaatgctttgaaatgtaaatcagctgaagcaccattctgtagattcttttgagttgcctttttactcactttctggttctgataatcatctgtggcctttggtttgtccataagtccccccccccaaggccgtttccatcctaagatcacacattacacatatgctgtgctataatcatggggtagacagctgtttttccactggtctgttacaggtagtccttctgagaacttctctgtgcctattgatggaggtgtgcaaagcttgctagttactagtcctaggatagacgtttctggatcataggtcaagggcaccattaacaatattagatgaccttggcatcatgtgtactttgttttgttttgttttgttttgtttgatttttcgagacagggtttctctgtgtagctttggagcctatcctggcactcgctctggagaccatgctggcctcaaactcacagagatctgcctgcctcggcctcccgagttcagggattaaaggcgtttgccaccaatgcctggctccaagtgtactttgtaaaacaccagaacagtattatatccattgaatgatctctatatatttgtcaatgcttgatactgtcagacttcaaaattctggccaactgaggggcatgggatggtggtacatcactgtgggtttggttgtttttcctatgaattctaaagagatgtagcatgttttcatggtatacttttggacactcagatggtctcttcagtgcagttcatgttttaattttttgctcatttttttttttattagtgggttgctcatatttctgtgtgtatctcctgggctgttcctgtctacacagaactccctgggttattactgtctctctctgttttatcaacgtatatttgtattctgctctttctttttgggaggcagaaaaaatactcaatttattttcggataggcagcattagcaagtaaaaccacactgtggctcacacattcattcacagggtatgagaaagccatagctggtgtgtcctctgtgtgcaaacaggcgaacagtcaaaccggtgaatgctttcttacggggttcacttctaatcccagaagaaaaggcatgcccaggcaaaaacccgaaacaataaaattttggtgcaacaactaagaggggaaagtttggttcacaggcttcatccacattctctggagaaatgagtctcttcctcattaaccatcagagcacggttacaacagctgtttaaagtcctgacatatacacaaatgtaataaaaaataaacaaacccatgaaactagccatgaagacatcttgaacatccagcactgctcaccagtactttgactcctgaaattgaagacctggaaatatttgtttttcacaaaagcaaagttgtcactacctccctccctcctcccctccccccccccccctccccctctctctcgggtaaggaaactgaaacaacaacagaaagaatgtggagctgtgacgggaggaactggccctcctgggagtttctctcttaagaagaaacatgcatcaccccctcgcccccatgcagcaggcatgaaacaaacatatcaaatcaactgaggtgtctgctctgatgcctgtccactccagggtctgggaagaaggtcggttgttacgataaatctttccgccaaaagctgcctgagccccaccgccacgtgtgagctttacaccagccgccagcctgagttaggataaaatgaatacagagaaacttgtattaggtacaatgctgcttggccaatgactaggacttctcatctgcgagctcagtcttaattaccataaatctatatattttataagtcttatcttatcagacgccttattggcgtccctccttgttggtggatcacatcgtgtcgctggagtaggagcggaggggaaaacagggcccttcctgtttttcctacacttaaatatgagtctccttgctatgtcacttcctgcctggatcaccacttctctactacatttcccagaatcctctttgactcctagtcccatctacttgctgtctcattggccaaacagtattttatttaacaatcaataagataaacatacacagtacattccccattagtcgtttgtgggaggtgtggggagcaggtggaattcttgggcacccaaactgtttaataagcagcaggaataagtcctaggggccaaggtcagttttcagagggcatcctaccaagggctccaaggttaaaggaaatggattaattttttttgtttgttttagctttttgaggtttctttttattcctttcctgctaaagtacattaaaactaaaacaaccacaagatgaatacagcatagaaaccagttcttcctacacaggtgttcatttacctgcacatagtcaccatggaagtacacagtacactggcaaccccaccctacatcggggtaagtagttgtcccttccactgtggtccattgagtcctaactatttttctctgaaacaggtgacagtctttggaaaaaactatgaggccatacacaacttctagtacatgatttttcccaagcaacaaaactatttttcaaaacctgcttcttccaaaattaaaacaaacaaacaaaaaatttcgtctgttttagtaattttttgttttgtttttttctattttcctaatttttttttcattttttggaaagcaccatagcagcaatcatgattgtaggattgccgaaggctgtgttcacaagcataaatatcatttgcatatcaagaagagaaaaaaaaaaccaggaggaaatggattaagaaaaaaaatggaaaactgaaaaataaagcagaaattctggaatcttgccctgactgaagtcttgttttctttcagaaattgggggaactggtatttgaccacagggtcgggaacattaggctcctccacattctggctcatgccactagcttggaaagtgtagcattgcttacggcagagatgacccccagggtctccttggacttcatggctaaaccatcgctgtggacaatgatgcaccggttccacacacagcaggggccacgctcacagaagttccttggaaaacatgcctctctcccttcacatctggcacagtcacggggttctctatggtgaggtttctgtcctggcaggcttattgttggtccaatatgtgatttagtggaccttcaggttgtgtttggtggggagggctccaccacatgtgtggcagacaaggcttttctctggtgtgcgtctgctcacggatctgaaggccgctggtagatgagttcttcccacaccctgtcactgtggctctactgctagcaaaggtgtcatggaggagggttaatgtgggaaaataccaatacagagccaggtaaaagaggcaggcggatctctgtgagttcgagaccagcctggtctacaagaactagttccaggacagcctccaaagccacagggaaaccctgtctcgaaaaacaaacaaaaacaaaacaaaacaaatacaaaggtatttaataggaaaaaagccttacttacagagtgacctagccagccggtggggcagcagtctggacaccaagcagaaagtgaaactgaaataaaaaccggccacctgaacgcccctcactctacatcaccctgaccacgccctcgcaggcgtggtcaggcacacctgtagccagccactaagcaggcgtggctacagcatcccctacagagggtcccacaaaggtgccgtaaacttcaacttggacataggtgggcttacttggatatattttcaggagtacaacacttttgtttgtagaggatgaccttgtccttgtccttgacatacaaagtcaaggcagagatatttaggagcttcccttttcttttctcagatgagttgagttccacagtagagagaggaccccaaaagagcatatagcctggggtctgaggtagcagcatgcttgggaggccagacatgaatttggggaaaacacaagtcccatcacacttcaagctgatgggcgtaagagacaaggacagtgagctggctgtggaggaaacactggcctgaagcagcttggtatgtagagacagactaggcttgcgactttccggcagagccactgcattgggcatcttataggactaaggtcgcccgagtgtccacattggccactccacagtagagcgcatgggcaatcctagacttggactttttccgtgagctggatcatttggagctgctgctgtagacacaggatctgctctaggacccatgggatgctgtgggcagcttgcacagaccctgatccgtgctccactggttcactgccatcttggcacctcagagcacctgcagagtcacaccagtgtggaccactttgcatttgggtaaatggcttatgtcctggggtaagggtgtcagggcagcctctgtctttaagtaaaggttgaactctgtgcccagcttttccttggagttccctgagatgctaactgctctcctgattgactgatgactgttcttaatgcttgggttggctgactggtagctcgggatggctctgccgaagtcatcggaaggcactggcttctcactgatattcatgatgaagacaggaggattttttagtgcaacattgttgtgttccatgaacctagagagactgaagaacccagcacaacacttcctgcagatgtgagtcttctgctgagccactttgctgtagcagtgtcttctgtcacttcatcacttcatcacttcatcacctctctccctggggagttcactggagcacccggtaccctgtggttgcttgccctgacactccttcaagtgctagggctttgcctgcatatgcctcgacatggtgcacacatcagggtgctggggagagccctggtgactttgcccctttccatcaccagttcctagggttgggaaattttacccctctttggtggtatgtgcgtgtctcaataataccctcttttctattccttatcttataggtcattcttatgacctgaattgtgtactcctgtgaagacaacatttatacattgaaactcaaccccagcatgtgcctgtgtttggagacagccttgtttaaatcttcatttattactatatgctagtaatatatcatttatttcattgtgatactttcatgtatgtatataatgtatgtatataattttggttgtagtcactcctcatttacccctctcttattctgttaatnnnnnnnnnnnnnnnnnnnnnnnnnnnnnnnnnnnnnnnnnnnnnnnnnnnnnnnnnnngcttctgtctcctcttcctcctcctcctcttcctcctcctcctctttctcctctttttcttcctcctcttcctaccccctcttcttcattcttctcttctccccttcctcttcctcttcctctcccccttcttcttcttgctcaaacaattttctgtacagaagcatgggtgagaggcaagttacaggatcctgagtcctttacagtgcctatgcctttgaagaaaatgaggttgccttttaaagaggcaattggacctaaaatgaagccagtagagtgggtccttgcccaatataaaacagtctttatatacacagaggagatgaggacatggggagatgagcacctgaaagtcatggagaaccatttataagaatttaattctgcaaagaccttgatcttggacttttggctccctactgtggaaacatgatttcctattttttaaaagtgattcatctgtgcctgatggtgctttgttttggcactttgaacaggctaatgtagttgtcattttaactaattcctagaactgggaagaatgtctaagtcagtacagtgcttgctttgtaagcatgagggcctgagtccaatccctaggacccaacctgtgcacagttgtaatcccagagctgaggagtcagttaggactcattggccagccagcctagccaacttcttgacttccaagatcatgagagaccctgtctcaagaaacatgctagacatcctctgaggaacaatatctgtggttgtcctctggcctccacatgcatggtaaacttgtgcacacatgtgaattgccaggtatggtattcagtctttcttcaggttcagagctatcagagtcccttgatgcttttggggtggacaactaggctgctgaagttaacatgagcacctggggggaatgtctcattttagtgacttagtagactagttgcttgctccaaagtcaatctcaaaagacatgctctggatttttataaggtgttttaagatcacctttgccctgtcttttaggaattctgcatgctttgactcatagttaaaatgtcaacactcacaaatcttaagaatttacatgtaatgcagaatgatttcttcacagtgaaatttggttgtttttttttttttttgaataagatacatatcccattgagtctggattttttttgaattgttgaattgtaagatttctttcttttctcagatatgccatgtatatttgttgtctagtcttttgatggaacatgtacacaggtaagatagtctcctctttcctgagcagaaaaattatcatacatggtttaaacctagggctggtaagatgtctcagtgggtgagatatggcgccaagtctgacccacactgtggaaggagagaaataactcctataacttggtctctgacctccacacatgtgccgtggcatgaacacacatgtgtccctacacacacataaataaatgtaaaaaaaccctagtttttcattaaaaattgaaatctaacaaaaattttgggtatatgtgtatatatgtgtccatgtgtatgttggtacacatgtgtgtgcatgcatgtggaagccagaagacaagcttgggtgtcattcctctagtatgtcactacctgatttttgagacagggtctcccattcactcttagcttgctcattaggtgaagctggctttccagaaagctccagggatctacctgtctcttccccaaacactgggattacaggtgcatgccaccatgcttttctattttgtgtgggctctgggaacccaaatcagatccctgtatcagtgaagaaagtgctatactgaaagaactatttccccagctctaaaaccttaatattggaaagttaattctatttgtcaagactaattaaattcaaatgctaataaaacagtagaacatcttttgtacagtgacatgctgtttctttggtttttaagtcataggttcacatgaacattgttgttcatgcttagcatcagcagctggcatcctctgactatttagtgccaaggcaattagcatgttacatgtgcatctcatttggttcttgcaatgactatattaggcagtcatctcaggcttgagccatgggggtatagtccttacaattctggagtctgagtgcaggatgtccacgtggccaggtttcacacacacacacacacacacacacacacacacacacacacggtagggggagagagagggaaggagaggagagacagagagacactgactccctgctatcttttctaataaaggtacgaattcttcagccttcccagtagctggaatcgtaagcacatgtatggcagcttgaatgtggttggcccccataatctcatagggagtggtgctattaggatatgtgggtttgttgggtgggtatggccttgttgtaggaagtgtgtcactgtgggggcaggctttgatgtttcctatgctcagcataccacccagtgtgtcagtcgacttcctgttgcctgcaagatgtagcaccgcatctgccatgctctgtggcatgatgatcatgaactgaacctctgaaataatatgtgagccaccccaattaaatgattccctttataagagttgctgtggtcatagggcctcttcacagcaataaaaaccctaagacaccatgccacagcatccatatataataaacaaattttattggccatcatatttctttacaatgcaaagttatatgtacatgttcaaattttaaactatgatcacaaggctgtaaatgctaacatgttttgggtttatgaactccaactaaatatgtatgataaatgcataaatgtagggaaatatggccaaaaattctagacagattttgtagtctgtctagatttgaaatccagattgtcccagttttgtcaccttgcacagtgttcttaacctctctgtatatccagccacctaacaggaatatctagctctcagagtttagctcatagagtcatctgttttaaaaatttatattattttcagttgtgtgtgtatgtttgtctgtattaggcaaatgtacttgagtgtggggcccaaggaagccagaagcacagctccacctggagctggagttacaggccattgtgatctgtttgatgtgggtgctgggaactgaacttgggtcttcgggaagagcagcaaattctcttaattgctgactcatttctccatccctcttaagagaatttgctgagctaaaatatgttcgggagttaaggcccacagtaagagccatgtttgctcttgttcttgtgttgatgcttatacacagactgtaaacttttgttggaaattatcagttactagaaagagtcaggaagagagccaccccaattttccatgttaacctgcacgagcttatgcaggcttgtatctctttctgtgtgtgtatataatataagaagatcacctaattaggtttacatactaatgactcaattttcagttttacattttcatttttgatactccttctctgcattacctgacttaattttatcgaccacctgacatccttgctgtcactttcctctgaaccacacagatttatggattatctgtttacttggcacctcaggaggtttttacactgtaaggtggtggatctttgtgatgttctagaagaaggaaaaattgacctttcttttgtaaactggtagaaatagcttctgggaaagaaaccacaaggttcgtggacctctggctttctcagattgattaaccactgacatcatgtctgtgagcgagtccatgggtggcctctggagaactgactgtgtggtccctgtcactgtgccagcatctgctgccctgaagtctctattccttttcccgcttagagtgggtctattaacaaactggaacagacaaggctggaaacaaatgctatgatggttggacatgtactgtaggttaaattttgtctctagggatcaacctgtccaacatacaacaaccttacagcataaggttgttcccttatgctgtaaaatgaacgatggctttgttcttaggattctcaaccatgtagcttttatgtcttgttttgtgttctgttttcatagaaggctgtgacaaatttcagcagatccaagaagagtcccagaaacagcattttgtagagtggtggccttagagcaccttgttgagcacccaggagttcaggctgcaggtgctccccacccacacgggctccagagagatttttagcctctttttttttttttttaatttcttcttttatctctgctctgctccatcataagatatactgtcattgtcatggttttagcttgagttaagaaaacatccaaacaacaacaacaacaacaaccacccaaacaaccactcactaatatcttaggatggtgcattaaaaattaggcattagaattcacaggataatgccaaaatacctcagtgggtttgaagatctgaaaaccaagatctgtctactgtgcttgctttatcatctaaagcaacccacaaacctaatcccccagtgaacactttcctttctttgtaggctatttacctttcatgtcttctgggctgacaataatctcttaagggttcagctaggttatgccaaggacatttgaagtccaggctggtaacaaacactgggttcagccatcccttggtcttaggagaattgacaactgctgttcttatggccagggccttagagaaagaactgcttcaggctaattggcaagcagcagggagtgcatccaagtgccaagtggcttacaagggccaccacctgcccgctgtatccatgcagactaaaactttcctgcagatgcagcatggtggtgcaggctggatttggagtagccagcctgagaaccttatctttgtgacagttgctggttgaatcaaggaaacagaacttgactctaaagtctgcctgtgtctcttcagagatgggagtgtgtgttcccctgctggaaaccagagtagcccctgagatattggcacaacagcctcttttgaatagaataaccatcaggctaatggtccttctcttgagcaaatgagccactttgtagttgttcaaggtagcttgccatctgccagtgaagggaccatcttcccattttggcagccgtaacagcctagcatgtgattgcctgaccttgccttggtcactaggaggtcagatgcctgccttgtggcaaggaaccaatcagaagttagctggtgatgctatgttttacggctctgggtgtgctttaaggacaagtgcacagcaatgatgcacagagcatagcaatcgccctgggagggcctatgggccataacaaccagttgaccaatcacagggcaagttctccaagcctggaagcacaccagtcctgagcctgtgcatacccctagacactccccttatgctgccctataagatctctatgctgtggctttgaagcgtctttcctagccatcctccatagtggatggatgaaaggcccgagctaatggggttagctcattaaacaactacaataaagcctcgtgctgtttgcatcaagcttttgactccacctggtgattggggtcatcacagtcctggccgagatcctgggggtctgaaccatcggaggtctttcaccaggagcatctcactttcttggcagacgttttcataggatggcaaggcagtcaatagcagcctttgcctttcttcgtgttttatgcatgttacatatcatagagatccattttacaggcagcataataaacaccgagctgttatttttgtgtgtgtttacatgtgtgcaggtacatgtgcatgtggtgtccaccttgtcttttgaaacagggttttcttctttccctgggttgagctagctggccagtgggccctagggatcatcctgtttctacctccctggtgctgggatcacaagcttgcaccaccgtttatgtttttttaaaaaaatccatattttatctggtggctgaactctggtgggttagggttaggctttagggttagggttagttttaaatttaaaggaaaagtttgggaagcaggtaaaagaatgtagggatgttatcccctcatgcctgaaaaagggtagatatagtaagaaattaccaatacagagtcaggtagaaatataagggtatttaatagggaaaagccttacttacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccgagcccccccccctccccccgcccccccccccccccggtggggaggagcacccaggtagccagcccctaagaaggcggggctacagcttcccctacaggtagaggatggacagtctcagcccagggtatgagcaattttcatcgcttttctatttttgccttcttttgaacatctgtgaaatcctcccttcccagtttcttacctgtcaccaccatcagtctccagctctgcctctctccccagtgtaaacactgcttcagttttctgtcttccctcctctccagctcatatatgttgtagtggcgtccctgccccaggccatggggctagggtggtgtttgggtgtggggcctgggcagcacctaccggttttcttttaaaaataaaatctctctctctctctctctctctctctctctctctctctctctgtgtgtgtctgtgtgtgtgtgtgtatctgtgtgtctgtgtgtgtgtnnnnnnnnnnnnnnnnnnnnnnnnnnnntgcacttgccagactcagtcggtcaggcttggcagcaagcacctctccatttaagtctcctttgctgtctgctttttttcccccataatgtgcccaatattattctaaatgttttacacagattatcttgtttactgttcacacaaccctatggcatcagtatgactgttctgactcctattttacagaaccaaaaggggctatcaggtacaggcacagctctccttttgcctggctggaggagatcctggcacttgtatctaagcaatcttcctcagaccactctatgacgaggcttcgaagaactctgacccttatctttgggtgtaagacttcaaagacttcatacttgtacttctttttaaaatagatttaataaaatttgatagttttagttatgcgtctcaccacagttctgtacctgtccagcattcttttctgccacttttcttctttgctttagactcgtttggaagaatgaactcttggcagaaacatcactttattttattccctcattaactgaacgaaactgcccacttgattctaagaacgctaaagctccactgtgctttgaccttgcattcgaaatatcttagatacatcttagaaatatcttagatacctctttttagtttcccatgtctgtaaaacaagtagagaaaaatatgctctagatttatgccagattcttaggtatctgtgtttccaaggaaaatcttctctttaaaaattcactaggcaaataaaaatttgctatttggagtgtgccatggctctgactggaaagctcaacctcctgagtgaggagactataaagaaaaacccaatcatacccgctccaggatagtttcatcactctttgaaagtatctcacaggctggactggaaactgtgggaggctggggtccccactgtgtagagcatactgtctgtctcattacagcccctctgaatggtgttgctgagtgaatacatcactgtaccccctcagaacctgccgtcagaggctcctggggtatctttcctaagtaatcagcatggactcaagtgctgtgggggatcgatgacagaacacaaataacacatcatcccaaccctccggaagcttccagctctgcagaaggctcaaacccctaactccctagtgcagccctgtgaataatggaggggagtggggaggcaacaggaagggaagactttttatggaggtgggactttgtgggagggagcaccctggagaaaacatttcaaggtagtctgaagaacaagaccaacaaaggagtagaaccacaggtgcaagggccagtccaaagagagtgagagggccggggccttactcagggactagccaagagagggatagagggtctgggtcttactcggggaccagccaagtgaaggcgagagggtcggggctcttttttttttgggggggggttcgagacagggtttcctctgtggctttggaggctgtcctggaactagctcttgtagaccaggatggtctcgaactcacagagatcctcctgcctctgcctcccaagtgctgggattaaaggcatgcaccaccaacgcccggcgagggttggggctcttacttggggaccagtccagagagagcaagaaggttagggacttagccctcctatgtattctcccactggcccctccttgggtgctaaaatcataggttttattgatcctagaaggactggggctagggctagacggggggaggcaaggactggtggaaatttggaggaaggtattttcagcaagcattaatggcagcaaagcctcnnnnnnnnnnnnnnnnnnnnnnnnnnnnnnnngccgacaaagggaaggaatagcttacatattacatcatagtaggtaagcaaaccctgttctagaaggaggcaggatacctgagggccactcagtgcctgtgttcccatgggcttcatggaaaactgaatttagcccaggcaagagcagaggaaggaaggagtgagtctagagagttgcttagacctttagtgctggggcgaggtgcacacatggctgacatcccaaggcatcccaagataccctaaacccacttgatacatatgttggagcgattagcaggacttaacttgctctggtcctcacaggatgtctgccccagaagccccacaggcctcactacaacggttaccttaccctcttgagacagggagcagggtatgatgcttcctctaccacttcagttccaggatttccacagatatcaaatccactgttttcttttgatgctgtttctgctatgccgcaaaatttgcccattagttttgttcccccactactttattctttttctgtggggagggaggtcacaatttacagacaaacagcaagaacaagacggatagcagcaacaaagccaggcatgaggaaacaggaggcgcagagatgggaggggctcttcagtgtgagaaagcacagcggggtactgatgcttgctgaaaatctccccggagtctccggtagtgtcaatacaattctgggaactcggaaactggttctcacagaaatcattattggtagggatggcagtttccaagtgtggcgttttcagagtcatctgctttagagccttctgaagcactcccagcgtctcagtcacctccccacactgctgcagagactgcgggactgcctctggaggtaattacttcagactgagcttcacgctaatggtgctacctcattagcaacacggcttggagcgagcgggcggctactttcaatgggttttgaatggagatgaaattaaagtggaattgttgggtagagaactgttttacgaatgtcctcacacaaagggaacagtaaggatgttgtgccccctcccatcttgtcttctctaagcctggctttctcttattacagggccagggtaagtttcagcccctctctgtggttgggttcctccctaactccagatgtgcctgtctctagctgttggcggtgttttggtcataattctgttttgtatttcaagttacaattctgttttgcacagttaagccacacacaaacagccttaatggaaaagtttgatttctaggatgtagggggagaggatgtaagtgtgtgtgtgtgtgtgtgtgtgtgtgtgtgtgtgtgtgagagagagagagagagagagagagagagagagagagagagagaggtctagtttccatcaacaattggccttttgagggattattgtacagtgtattatgatgtgaattcaccagactttccaggatcccagccacaaatgggatccttgtaaatatcatgttaacaagagaatatctaaaaaggtgtggaagacatacgcttgctcactcatacatgagcaaactttgtatgctgctggaaggcttgaggccacaggattgaaaaatgccatgaaggaatgctgtgtatgggtgatccctacccgtgcagatgtagggagacagaaaacatgttagaaccagattgcaaggattgccatgggagctgttgatatttactatggattctctggatgagtattgttatccaagaaactaatgagaatgatatatggtcctggaagacctttctggaagcatgattggagacaatagtgtgtctagaaatgtagcagggcaaattaggacttaagacagtaaatgagagccctttgagacagggacaggccccactgatttgagagcaggggctatttctggctgaatagcataccagtttaaattttctttctctctcatttgccctgaagttgaattaaaacaaccaaggacatgttggcttttgaagataaattaaccttgaaactaagattttgattgaaatttcatttttttaagattagatttgtctcatttgttcaattaaacatgaggcctctacaaatgaagtttgaagacgttcattggaaacattttatgctttaatagagccttttcctcccattcgagattttgcttattaataagattcatagaaattcaataaaagtttctttcatcattactctgtactctctcaagagttgaaatacccatttaaaaataaaagatgagtaaaaagcaactcaggaactcaaatgaaagcaataaaatcttgtaaggatgtgtatcgggaagtttcatgtgagcagagattcattagtgaacagaggagagaaattcatggactttggtctgcagctgtgacctgacttttgaatttgttagaatggttccttagtccacaaccagttcctccatcttctactacctgtgtttagaacaaatagacgctttctaggttgagcattgtggggaggaggggtcatagttaaagaatccatttgtctacacaagtgcaggcttcatgggagaactataatgttgtctatcaaaaagtaaagacttgattttctgtatttgatccactaaggctgcaggggttttctgaaaggaatgttcctggatgtgtttgtagtgagatattatttatgatttattaaagtttgaggattcagaaagcagagtcagccacaagccatagaaaccaggcacacacctttactcccagcagccagaagctagaaggtggtggtacacacctttgatcctaggactcaggattaagaggtagactgatctctgtgagttcaaggccacccagatctagacaaaattgaatcagtctaaaagagaattatagctcacacttttaatcccaggactcattggaggtatattgaaagatccccagaaggctcagtcccccaggatctcggtccaggaacgcagccacctcaatcaccatgcagaggtggaaacttgatgcaaacagcaagaggctttattgtagttgtttaacgagctaaccccatgttagctcaggcctttcatctacccaccatggcggatggctagaaagatggctcgaagcgtctgcatagagatcttatagggcagcgtaaggggagtgtctaggggtatgcacaggctcaggattggtgtgcctccaggctttgagggtttgccctgtgttgattggccaactggttgttatgtcccataggccctcccagggtggttgctatgctctgtgcgtcattgctgtgcacttgtccttaaagcacacccagagccataaagcatagcgccaccagctaactcaaactggggagctggtcttttcaatataagacaggaaggagcaagagtcagaaccaggcaatcagtctccagccactctgaggagagcttgagggtcagccctttcagcctgaaagggtaagaattagtggctggcttctttgattttctgaccttcagcttgaagtttgaaccccagtatctgtctctgggtcttttattaatttgtgttacacctgttgttcagtgctgaagagtacagggttggttcacgcttgaaattttaaccctctgcttccctagatgtttggctgtgcaaatcctcaggctctgagcatccatgaagagatgctcatccctacagtctgggaagactgtgagatgcagtctttgcctggatgctgttaacactgtttcagtgtcttgagtccagaatgcctgtgtggaagtgtaagtttttttttttctttttcttttggagggggtatggttaaccaaatgacataacaaatataaaaagaaagtattttcctggttttttttttttttttttttttggtttttcgagacagggtttctctgtgtagctttggagcctatcctggcacttgctctggagaccagggtgggctcgaactcacagagatctgcctgccgagtgctggtattaaagatatgcgccaccaagcctggctcttttctggtttttgtaaggagtaaatcattagtgtttatgtatgagtgctggggccctggcttgtatcagtcccatgctacagatgtaatctatatgggactgatgtcttcggggctgccatcggagccagccaaatggctatgggtccatccctgagtgggggagtgatggacagggaaactcttagctacctaatggtgataaattccagacacaggcatcttgtcatttcaggagagctcttagtcaatgctggaaaaccagagactctggtttattcaagcatcctcctaaatagcttttcaacgggggtgggggggctgaccgcagaagacatctactatcatatattgaagggacccgctccccatttcggcagccttgacagtaacacatgcttgccaaaaccttgccttggtcacttagaggtcagacgcctgcctcgtgacaaggaaccaatcagaagttagctggtggcgctatgctttacgaccctgggtgtactttacggacaagcacacagcattgacgcagaggagagcaaccaccctgggagggcctataggccataacaaccaattggccaaccaacacagggcaagccctccaagcctggaggcacaccaatcctgagaatgtgcatatccctagacactccccttacgatgccctataaagatctatatgcagtgggttcgaggtgtcttttgcgagccatccgccatggtgggtgggtaaaagatctgagctaacatggggttagctcgttaaattacaataaagcctcatgcactttgcagcaaggtgtcgaatctgcctggtgattggggtgaccgcggtcgtggcctgggaccccggatacccgagttttttgggggtctaacaatataaagctatataaaaaaattgttttagctttagcagcacacctaaacagtccctaggtgcataaataaggcctcagaacaggtgcaggcacaaggggcctaggtctgttgttatgcaaactagtggactttctcccttgaggccaagccatcaagcgataatttagccagcatctgaaagacaatgagagattctggctcctggaaatggagtggaagtttggaccccaaaactttataatccatttttgggccccgaaatattaggtatgttcagagctcatctatgaatcacaggtatgcaggacacactagaaacattgttgccaaagctctctaatcccccctcccccattcaaatatatgagaccaatagggttgtgactcacaacttaagaagctgatgtcaccctattataaatactggctggcttgttttgaggcagagagatggctcaaaacacactgctcttgtagaggacctaagtttggttcctagcacccacattaggtggctcacaaccctctgtaactccaagtccagaggttctgaaccctctcatggactctgtgggtgctgcccctgcaaacatccacactcagacacaaatatttaaaaataaaaataagtaagaatgtattgggggaattcaaaagacctcaaataacaaacaacaaaaaattaaagagaagaaaaagctggtacctgtgttttgtgtctgttagacccccgaaaactcaagtatccggggtctcaggccaggttcgcggtcaccccaatcaccaggcagattcgagagcttgctgcaaactgcannnnnnnnnnnnnnnnnnnnnnnnnnnnnnnnnnnnnnnnnnnnnnnnnaggcttacgcacaggctcatgattggtgtgcctccaggcttggagggcttgccctgtgttgattggtcaactggttgttatggctcataggccctcccagggtggttgctatgctttttacgtcattgtcgtgcgcttgtccataaagcacacccagagccataaagcatagcgccaccagctaacttctgattggttccttgtcacaagacaggcatctgatctctacgtgaccaaggcaggtttatggcaagcatgtgtttggctgttatggctgccaaaagggaaacccgttccttcatgtcgtttcaaaggtgactacacaatgactaatgggaagttgctatggtccattgcagatctatagcacacagtggtagatataatttgacaattggtatacaaagtgaagtcatgagaccagtgtagatttgacaatggatcattcggtgagaattggataccttttgagagagagaaaatagttctcaatcccttccttcataccctattcagaaattaatccccaaatggatagacatcctgatcatgtctgggtaagaaagattgctatacaaattagtacatgtaaaaaaacccaaccaaccaaccaaacaaacaaacaaattagtatatgcacttgcacataggtgtgttcacacacaggcacacacacaggcacacacacacacacacacacacacacaagccttgccatgaggccatgctcagcaagaaaaagctgcaaatgatagacatacaacagcattgatgaagatgaaaaatggtgcagagcaaaaaaagccaaagcccaaacatgtactgcatggaattctacaacattgagacaatgtatagtgactaaaagaagcagtttcctcagactacttnnnnnnnnnnnnnnnataaaggacatgagggagcttctgaaagtgatgaaaatgcattgactcctaagatgtatttgaacacttacaatgtatgcattttattaagtgtgactctcactcataaaaacaattccaagccaggtattggtgacatcaacctttaatcccagtgcttaggaggcagaggcagatggatctctgtgagttcaagaccagcctggtttacaagagctagttccaggacaggtttcaaagctacacagagaaaccctgtctcaaaagacaacaataacaacaacaaaaaaattccaagagcaaaaaccattacatacgcacatattttatagttttattttatctctttaaatagatagaactaaagcttataggtagccctgtgccctatataattatagtgtaataggataattttccagtcagcattgtatgctgtagctgaattcaatttctaaagtgtggacctccagggctggagatgcagctctgtagtgcagcttgccaagctcatactagccttgaagtccatttcacccttccaaagaaacgtggctgtcagtatctggtggtattgcacagtgcagagtaagacttttgagatctattagactgtacacacttgtttattctgaacagctgtagaagttattaaacacatctcctcttttctttctctgcttgtaactttaatagaatgtaagtgtaaaaaatgttatgttggttgatttcaatctgatgaaagaattcgattgctataaagggcagatgagaaaacgttagttctattttcagaatgaacgagctgaaaccagttaatgtttattttccacgggagaaatgcttgcttttgattaaacttctttatacacagtggctgagtgatggattccaggatgtgttctgggagagatggagcatggcttgctttctttgagtctttgtttaagttctcatcggcttattatttcgtgtgcactgactcattggaagaccatgtttttaaacttctagaatgtgggatggaaatgtttcagaagagtttgatttaggtctgatttcaaactttatatatattttagacagggtcttgctacgtagctcaggctagccttgaactcatggtggttctcctgcttcagcctcccctatactgggatgagagtacatgctgcctgtccttgccgtatctttagaccattagtaacagtaagaccttgttattagatctttagaagacagtgtgtagatggttcttttcttccataaatcttagtgttgaattaaatgctgaacttgttacttgttgtgtgcagattcttgagatgcatttgttttggctcacagtttgaaggtgtcttcatggcagcaggatagtgaggcagcatggtcgtgtcacatccatagtaggaagcagagagtgacgactgctgctgctctgcttgttttctccttattcagtgtctgtcagcccccccccccatccccccatgactcaagaagcccaggcagtggacattttctggagcttgcttggctcaaggttaaagaacacatgtctgaaaagttaaggtggtaaatgggaacctttccaggcatgttcaatttcttccttgaaaacttttgttgaaacacaaggaaggggaaatttgaaggtgtattcatataaaggcttgctcctaaggacacccacttctcctatctgctaaccattccagcctccagaggaaaaaaaatcacagaaaggaagtgtagggagagatcctggatacctgtaccactgaccaggcccaaacgggtgtggttgcaggtacttagagggatagaataaagagagaggacaggaggtgctcctcctctcttggggtacaagccagggggtggtggctcatggcacgcctttaatcgagcactccggaggtagaggcaggcggatctttgtgagttcgagaccaccctggtctacaagagctagttccaggacagcctccaaagccacagagaaaccctgggcgtggtcagtggtacaggtatccagagtctctcccgacaatgaagggccatccctgctcttctacacattcttctgtgtaaaattctccgtttgaggggacagggttgtcaggaatagaatgttattgatttttctgccttgggaccctggtgaaattggcttaaggcttcagcgaggcccctactttccacttgcctattagaagcatacaactgggagaaacagaaagagtaagcagagtgtgggctcaggaccagactgccctgtttccttctcagccctgctagttattgcactcacaaacccggggacgttggttgactgtgtgtgcctgtgtctttcatctttaaatctcggtttaccattgaccaaggagcacttagctttctatggtggctgtaaagagcagcagggttactgcatgtgtttcgctcatgaggcctcagtgtgtattcactacttctgggctattgttttgtaagtacccatagtgtgcatctttcaagcactcctggggtgtcttcttcagagtctgccacaggactgggtgcagggccattgcccaatgtttacctttcaggtggagcactgacatagaattgttcatgatagcagtgaaatcagagccacccttttgtttctttccagttgagtggtaattccccactatcctgagttgttctagcatattgtcagtagattcttatttctgagagaagtgttggaatctcaggcatattcctgctagggcgaagtctgagattttgttggccctcacaagaggggcagcagggcatctttgagtgagaattctgggttgagggtgacctattgaaatctgactctcctacacagcttctagctgtacaaccctgagcaagttactaccatttagtgccccaggttagcctctataatgtctcaataataacagcatgtgtgtcgtgaagttttactgaggatttattgtagatggggtttctgtcctgcctggtcctgctgcccttcagtcccaaataaacatatagatgcttatattagctataaactgtttggccagtagctcaggcttcttattggctggcactctcttaactattaacccatttctattaatctaagtatttccacgtggttttggcttactggagaatgttccagcatgttattccttcggctgttacatggcgtctcccttgccactcactctctgcatcctctcctcagacttctcctcgtctgttagccctgcctaaatttcctgcctgtctattggccaatcagtgttttattcatcaacaaataagagaaccaaatatacagaaggataccacccatcaatttatatatcaatataagtagatcaattagggaatgcccctgctcaacatcaatgtttattgttatttgttattgctgtcatggtgtcactaggatcttgctctggactcccttcacttctccagtcctgtggcctctgttgaaaaacccacacaatgtacacagagtatagtgtgggttataggttgggtttattacagagtgaagtagaaagctctcaagggatgagagtcaacaatggccacagggattgctggagattgaagtactctgaagggccagagagtggacaatgaccagagggcccattgtcctgatctgaagttttgacagacttgatctccaaagtctgtataacaggcagcattttcctaagtaggtaattgacaggtccattggaattgagtcttacaaaggcttccatgtagacagcgatcttttaaggcttagatatttatctgttcattaccttctgatgtttaagatgtcatttctctaaccacggccagagataaggctctaattccattctatgcatcagtcattaaagcaccagagtttcagtgctggccatgcaagctgctgattatgagggagaagtacattcccagggtcttctaagcctggtaatgtcttactagctacttactaattatatggtagtataacctccatttttcaagatagtctcagtgtcaaatattctgcctcacagcattattagactattatttatttgatcctcatgccaattaggaactcataaaacatgactacaaaaaccttggctgtttttaaactttgtactaagtttacatacacactgttatttgcatggattccttagaatttagaagatggaaatagaagtttaggaagatggaaataaaggagaaaatgtaaggaatattgttattgcagagaccaaatcctggttcctcattttctgcctatggcgacctcacttccccatccttctctgggcttgcaggctcatccccttcaggaatgtgaatgagtcatactctcactgtaatacatcggtagtctgtcactgaaggttaaaaagcactgagaggatgcctggcttccagctcatattgctccaacgtctgacattctgctttcctcatccctatccaccaccaaggagatttcacttcttgcctctaggtctcctcaataattctaaaagttccccatctgctactcagatgttctcccaaaagtccttcatccattgcttgtcctggctcctgtaactgatgctgtcacctagttggtggagttatccctatacatcttactctgcattgtgggggtgctcctaccatggccctggaatggtaccttataaatgttacgtgctggggacgctgttctgctaggaatccgatcctgctgcctgcctgcctcaacaccctttcttggctccctatcatcttcaaaaggaaagtcagtctcccaacctgtcttccttaggatcaccattgctgtgatgaaacaccatgaccaaagcaacttgaggaggaaaagatttgttttgctcacagttccataccacagttcatcattaaaagcagtggtggtaggaactcatgcagggcaggaacctggaggcaggagctggtacggaggccatggagcatgtgcacgggggtgggtggtaggtggtggtagaggatgctgcttactgacttgctcctcacggctctgctcaacctgctttcttatagaatccaggaccactatccctggggttgcaccacctaccatgggctgggcctttccccatcaattactaattaagaaaaatgccttagttgaagtttctcagttgaagttccctccatttagatcattctagcttgcatcaagttgacatagaactagtcaggacacctgctttttcatgttttcccatgcggtgccagcttgggtctcccatctcgagcctcatttctttaatatcggacctcagtccctctcttctctctgagttgttttcaggttgccttgtgggccctttatctatcgtcctctgtgtctaagctccagggtctgcctgtcttcctgttcacacatccgaaccccatctttctgtccgggtcttctttgttcaggatctgagcttgctctttgcttaccttactcctgatgctcaactctgacctgcagcgtgaagcaatagtcagcagctgcagctgcccagccaatgtctctagctgcttctttatcttcctcccacaagctctttacttttgtcagcctcccagctgtggcttctcaggcctctttgaaaccactagctgctttagtcatatttgtagccatcttgcagcctacatgtatacccaggtatagatgatacagccatatagatatttactgtgtgatgtgtaattcgtagtttgagattggaaacgaagggcaggagagatgacccagccattacaaggtctggctgcctttctagaagacctgggttcaattccaagctcccacatggtggctcacaaacccctgacctgtaactccggttctgggggatctgatgccctcttctggtgctcaggcacacatgcaaggctgacaaacaaacacaacacataaaataaaactcactttctctggcaggatgctcacaccccttagttggagtgaatttcttctttgcctggacttttcacaccatttgccatctgttatctcttcctgtatggctggcactatgtctctgaatgtgtgtatacatggagtcctttctctgcatttgtttgtttgttcatcactacttttgggttttgaagacagagtctcatgtagtctggaatgactttgaactcctgttttccctcacatgtgccagggttacaggcctttccacctcatccggctgctgtatggcggaacctggggcttccagcacaacagatgagccacacccccagcacagaaactggagttttagcatgctgggacacagcttgtatcagtcccactctacagaggctatctatatgggactgatgtctcttgggctgagatcagagccagccacatggccctgcgtccatccctgagttggggagtgctggacagggaaactcctagctacccaacagcaataaagaccagacacaggtatcttgtcatttttgggagggctctcagtccatgctggaaaactggagtttctggtttattcaagcatcctcctgaatagctttccaacagtgggggtggcctcagaaggcatctactgtcacgtatatagttgatagcaagtaattcttttaattcaagagtcacctaaatagtccctaggcatgtagacaaaaccctcaggacaggtgcgagcacacccagggcataggtctgttgttatgcaagctaggagacattctccactgaggccaagccatctgggggtaatttagctggtatctaaaagacaatgggagattcaggctcctggaaagtggagtggaggtttggaccccaatactttataattgataatttttgggccctgacattagcacagtggatattttgctcaggtgactggaagtacatagggcagggcctggtgtgagagctcttgatcttaacttccccctggtgtcttacatatacctttggtacaatcagccccttagtactgaaaatgcatttattcttctctttcaaatgtcttgagcctccaaaagaccaaaatggtgttttgattcatttgacccagaaggtgagtagtgtgtgtctgacgcactgtaagataagcagttaagcatttactaaaatgaatttgtaatagcttcatttctgcccccaatgtaacattttctttccacccctgctatctctctcatcctctatctttcttttcttaccacccaggaataaatcagggagaagggctataatgtccacagtgagagagagcaagagggcagagaaaactgtggaaggaattatttctctacattttttaaaccacaggcactggcatatgcttggtcaatgctttcacactgagctgtagcaatagcctgatttcctccaccttaattcctggctttttgaacaaaaacattccattagagtcttgagttcttcattgactaaataaatacttgatcatttttgcttaaatgttgattctggaaactcatactttggtgtgttgtgcccaaactctgaatccccaaatcaccaagagacccaatccgatgcaaaagcaaagagtctttaattttacaagttaacttgggtgttacccccttccccctccatctgacacagcaggtgaagcaggcagggacctcaagcagtagtgggcagggaatatactggggtagagcaaggggagtgtctgggaggtctgctagttgcatagcaacagcctcaggattggtgcacctatgggcttgggcaacctgtccagtattgattggtcagctgcagctacaataaggttgctatgctctgcattccaccattatcagtaaagcacatctatagcccaacaactaacttctgattggttccttgcctcatggagggtatctggcttcctagtgtttagagcaaggtcaggcaaggtcagaggctcagcacatgttgctgagtcagaggcctacatcttgctgggtattttctgcagcctgtcatggctgccaaaacagggggctgagtgaatacccatacattcacagaatgcccatatattgcaaagagctttataaaaagttttcctaaagcattaataataacaacagttttccttattcttttagtcaggaaagagaatacgaaatcatgtactctaacaaaaaaagaatttgaattcatagttacttaaataaaaataaaaaacaaaagtcctgaaattctttttccttttgaagagtaggaaaaaacaaagaaacaaacaaacaaaaaaaatccaaaacaaaaacccaataagaaccaaaacaaaaaccaaacctctcctctactggctgaagaagcagagacacagcccacgtcatgacagattacagcttaatggtacaaagaggttttgggtctgggtcccctggatggaagaaagaaacatgctatggaaaacttactcctacagaagagcccgacagcccttgacagctgtgtttctttgatattcaaaggcagtttctgaagtttctaaccagagaaggcaccacagagatctctccacccaggctctgactagccttcaatctcttgtttcacagccagctcttatcccagcatgatacttacaaagaaagttttgtgcaggagaatgtgtctcctgttatcacagcagggatgtgtgaggcacctgggaatagcagcagtttcgttctggaagccagtttgaaagtcacagaaggaatggcagccagactccgggtgtatctgttataattagcagaaacacaagcattcttgcagctttatgtatgagaaaatgaggccagagatacttaactgacttacataaagtcacacgtggtcatttatgtcaaagtgtcaacaataaaatccagattaggctctttctggtgaattcagaagtttcccagtctaccatactagtaatttagtcagagaaacctgattattaatctctgcatcctctaaacttaataggtttagccagggttgttgccatgggtctcctcgttattaacaatgtcaaggaagttgtaacttaagagcaagccctggcatgtagtgagtttcagtttttatgtggatcatattttacctcatctaatctagttcctgtagcagcccttagcagggtgcttgtacctcatctctgccctaagtcctgcctaacctctcctgcctagctattggccattcaactctttattaagccaatcagaaggtgccttagacaggcaaggaagaacagcaacacatcttcacactgtgtgaccaaatatcccacaacagctttccacactcctttaagatacctgtactagaatttgttatcttgactgtccataaagttatctttaatttattccctaggtaggagttgtgctttgcttgattatatgtcctctggtgcatgctagtctattattccttgtttcttcacccctccctggtagatttttctctttgtcaccagctctgtgctttagctctgtcttccttgttttgccatcataggctcctcgttttagaagtcagttttgtttctctggtgcttgagttcttttgaagggtttataaattctgtgccccattttgttttgtgttttcattgacatgatgtaattgcacatatgtatgggtgcagtgtgatgttctaatacatgtaaacattatgcagcagtcagatcagggtaactgacatatccatcacctcaaatgtcagtcatttctttgtgttgggaataatgaaagtcatctctactagctatttttagatacatagttaatggttgtcagttatagctactggagactttagaagttattattcttttcgagtgtcctcctaaacccgataaccatgccctagcaccaactactgctttacacttccaagagagcatcttcccctatgtacaagtgagagcccattgcagtattgtctttttgtgcttgacttcttcatcaaacacagcgtcttctagttccacccatgtcactacaaatggcagtgctccaatctttcatggctaaattttatatttacatatatatatattaggaatgtattatatgtaaattatatatttttgtttttataaatttaaattaggaacaatcttattttacatatcaaacccagttccctctccctcccattctcccatgcccccaccacccccatcccattcctcttctgctaaattgaaaggatgaagccttctatgggggatcatcagagtctgtcacgtcatttggggcagggccaagggcctcccccgtgtgtctaggctgagagagtataattttctttaaaattttttattccattttatgcatatggatgttttgcctgcacctatgtctgtgtagcacatgccctcagtggccagaagatgtcagatcccctggaactggagctacagatggttgtaagctgccatgtgggtgctaggaatcaaacaaacgtcctcagaagagcagccagtgctcttaactgccaagccatctcccacccaacatatcataattttaaaagactctttcaacagtcaccgtggctgatgccatgttttggctgttgactacttatttccttgcttttgaatataaatctttttgcctctggcttgtaagaggatgctgcacaaaccagaagcacataccctgcctagaaagagctgcagcacagccaaccttgggtggcttttaaaacttgacttctcagttctgatcacgagggagccattagtagctgggggtagttacctggggtgcgccctcggtcagaatcatttagtctctcacattctctattttatctcgagtagtcagtatttccatggccgatcaataactttttcaacctggagtgagtagaatgtgctaatcaatggaatggcatgacataggattgtaaatgtgtctgctttcaagctgcgtagaaagctgtaattaaaagttaaaggatagaggagtcattgtgctttgattagagtgaggaaaaatgaaaggcggcttatgaactggaagcctgtgaaggcacaaacttccacctgcagacacccccggggctcagtgggtgtcatggttagcttctgctgtcaacttgacacaaagctagagtcatctggttagagggaaccttgactgaaaacttgcctcagtcagattggcctatggccatgtctgtgagacatttttaaaaatcattaattcatgttagagggtccaggtctctgttggtgataccattcctaggcaagtgggcctgggttgtataaaaaaaagcaacctgaacaagccagtaggcagcatttctccatggtttctactcctagttcttgcctggactttacttcatgatagattattgactgggaagcataagatgaaataaaaccctcttttcccccaagttgcttttggtagtggtctttataacagaaagtaaactagaacaactggcatatgacgtgtccaggcttgaatagttggcagtcatgctactacattgtctccttcatttgtccctggtcaagcttgcagttctaacattaaggttggatgactgcttttggcaaggcaccgttgtgatcttggaccggacctcactgatccggtctctaatcttgacacctcccttgctcctccttttaataataggggccgtccatcctaaatgcccccagttccctaccaagctcagtttgtcccaaggcattttcaggtgtttcttccactttacctcttccttcgtgacagctgtttctccgttactcctagggcttcttgcctgaaagtcttagttgtgccagatgctctggaaacctggattttcttctgtctcattgccctggatgttatttgtctgccagtcacttactcccccttgccatgagggcttgaggtctgcgtcattcctccgtctgtgtccctagcggaggaagacccgcggcaagtgcgtatcaaatgaatgatttcacgtgtgtaaaatccggacattttcccacttcagtgtcccacacccctatccttccttcacccagctggaaaatcccgatcaatgtaattggccttttacctcttgaagaaaatggcatgattccatatattatgtttctattaaaatcttcaattgcaaaaaaaaaaaaaaaaaaaaaaaattgataaaagcaaagggaacaatccttttcttgcaaaggcttggaacataatggcaaaaatcatttttataatgactaaagtgccaggctctagtgaacaccatgcaaagcctttaatttaaaattttgttccttgctgactgtgtttctaacacaaatgctctgtgatgtgatcatctggtggcattactatcaggggtcccagactctgtaaacatctgtccactcacttcagtcacgtggaggctcagagtcacctgaggcgaaccaacaatccagtctagagaggggcttcctggagtcaataccaagctcagcacatttttgtgtctatccccttatggtcaccgagccgaaatgatgctagggagggcagtggattgggacacagatgtcagagcctcacagatgcctgcatgtgctaggcgtgacctcttaggctgtctcccaccctatggaactgatgaagttttgtcggtgtctgactcgtctcatctgaaattcctgaagtggttagagtgctcattagaagacagacttcttgtctcaaagtctggaagcctgtgcctgatacaaagtataatcaatgtgtgattgtttgcaaaaactgggaggaaggttagagaaaggaacagtattggtttaaagtccaagtgtagcacagagcttggtaataggtaagaaatgattttttttaaacaagtgctcatcatgtttcctccctgcttagatgtctagaaacttactgttgtatcttatgactctatatttgatcctaaggtactaactactgatgctgatgcattttaaatttactatatatttatctggggtaagaaaagtcatcctttaagccatattaatattcagtgtaacttcttttatacatttgcacttctgtggcttgcagaagggactgcattctcacgagctgatctcactgggtgctaaggagttaccttaagggtgtagtcccagctaagtaccagacgactggaatgtgcaggcacagaaaggtgaaaattcttacaccagcaagaagcacaggtgtgaattatttccatggtttaaagtgtttaatataaggctggttattaaaaccccttggattcgagttcatttatttaaagaactgggtgcagggaaatgattgtacagaagcctgggcttgctgggtggtggtggcgcacgcctttaatcccagcactcgggaggctgaggcaggcagatctctgtgagttcgaggttagcctggtctccagagcgagtgccaggataggctccaagctacacagagaaaccctgtctcgaaaaaccaaataaataaataaataaataaataaataaataaataaataagcctgggctctgcctctggccgctcctgttttagtgagaggacagagcaggcacagggagttgtgctaaagccttggtgctgtggtcttccagcctggcctggggagagggtgggacaagggaggcttattagaggaagtgacatttacacaggacatgaaggatgggaggagttggagttactgacctgtggaagttgattctaggagatggagttagccaggtgctactcttggggatggaagacctaaaggatgaggcaactggatgtgacgtgaccaatgtgtaagacaagggcaaaggagaggctggcagcagttcagagacagtgctccagtgtcaactggaacaagtgacagagagaagctgaagtaggtgggtgtaaaggaggcctgtggcccaggcacgggctgtcttcatctccagcaggtggtggtcacacagtctcattcctgagatgcttggtgttactactatttcatggcctttgtgtctgtgaactctgtatcctcaaaccaacctaatctttgcttgaattagactgaatgagtttccattgccttctgagtcagagatcttggattttccaggcactggagcagtgttctccttttcttgatggtgacttctattctgttccttagttcctaagacttttctgtgccttcttcagggatagattatgtacaagcaacaccttttgtcctttcagttgatttctttatgtattcaaatgggcctcagtcagctcaaccttgggtttgttctactttccttaacaaggatttattatttctttttcttccagcactttccaggcatcaaggtctgaacccttgattttgatgcctgccaagccattgttgggatcttctgtgactccacatgaatttggtttagcttttgtcagtggataatgctggtgttctatagctgcatcatcatttggcccttgtgaagttactgggagacagaatctgagtaatgaacactatttccttggatatcagtttgctgaagccattagagtaaatgcccccatgtacgtagtgtgctactttgtgttgtgttgtttccttctgagtgtaaaattgaacaaaggtgatagacactggcctcttcaccatgtatgctggtgtctgtgtgactcatggttgttatgggtagaggtcatgctagtcagcacaaggacaccagagtgaggctgatagaaactcccagaggatcaagagtgagactgaatcctgttgctcgaagaagggttctacccagatgaagttcagatgtcatgttctatgtttgccagagcttagatcccagagctgatacctagccaagatgtgaccctggcctgttttccttctaaagtgactcaaactcccaagctaatcaggaaaaaacccacttctataagtttacctgaagttcaagagttggacactatgctgggtctcaccctgtcactatctggagaaatattcctagcatgacatcatgagcagcaagcttccttttccgtgaccccaaattcagcctgccaacaagcaagctcactgtcttcccaagaatttgaattcccttttcatgagctatgttctgtcaatgtctcaccagtttctagtcctgtaagtgagaaacaggttgtttctgacaagctctttctttgttgtctgttagttcagaacctggtttttgatttgtttctttgaagttatctttctgcttcctttctttctgttgccatggtctctcccagcaccagaagaccaccatcatcttgtgtgttattttcaccacgtcagtgtttgtagctcactgacttattttttggagtcgtctcttttgtttgaaattacagaaaaccttggaaacaagttttattatacctcttggggtttaaggctctcttcggcttgctataaatggccacctctccagccgtgtttcccaattatttctctttcctaatacacagtctcagctgtaattttattgttctcaaaaatactattttttaaatagttttatttcactgttccttgccagctgggcacctctctttctttcaatctttcccagttctgccttcttactggtggatgtccccataggcactgctgtgcccttcattatctctcatttcttgagttctactgacacttgatgttgataacatataaaccatccaatctctctctctctctctctctctctctctctctctctctctctttctctctcctccttttccctaatgagtctaagatttgtgggcagaatctccttctacgctggatattgcttatgaagagaagtgctgatggcacccctctttgcagtgatgagagatcgccatgttgagtttgtctataaggtgacactgtcgttgatctgctgtaggcagtgctaggtgagatctggaggctctatgaagcatctctgctgggtctggagtgactggagtaaagtgggtgccacctagataaacgatctgactgtcacagctggtggacagaacagagattgtggggatgggtgagacaacaaatgcatgccggggtatatgtgtacacgtatgcatgtgcacaaatgtttgcatatgttcaggtgcatgtgaggccagaggccaatctcagatgtcactacttaggagccatttggccagtggccttagaaattatgtctatttctgccttccaatcactttaattacaacatgtgtcaccatgctttgcatacatatgtatatgtatatgtatatgtatatgtatatgtatatgtatatgtgcgtgtatatatatatatatattatagagtatgggtgttttgcctacatgtatgccagcataccacatgcatgcctagtgcctgcagagcccaaagagggcactgggttctgtggaactggagttacagatggttgtgagctgccatgtgggttctaggaataaaatcaggtcctttggaagagcaaccagtgctcttaactgctgggccatctttctaagcccgggactggccattttttttttcatgaggctctggggatgaaattggggtctttgtacttgcaaagcaagtgctttacctgagctgtttatccagcctgaaatgctggccagaaagcaatcctatattgagtctggatgtttgacaaagtgcacaatacttttcccaaaaaggaaacacctgactaaatgttgatttagcacatcttttaaaatggaagcatttttttgaactttgggagccctctccacatagagggatactctctcagcctggatacactgaggagggtctaggccctgctccaaatgatgtcacaggctctgagggtcccccatggaaggcctcaccctccctggggagcagaaaggggttgggataggggcgtaggtggggaggaggggagggagagggaactgagattgacatgtaaaagaagattgtttctaatttaaatgaaaaagaaaagaaaatggaagcatttttaatactattacaaccccataaggtcatttacttcatcagatctcaggatgccatagaatcagggagagccttgattcatatcagtagcactctgtgttcagcaggcagctgctgcctgcattctgtttgtgttttgtgctcagcatgggcatcacagacttggtcttgtgacaaggaaacatttcaggctcccattatttcttcaccaaagttttctcaaaggcaaaactacagaaccccaatttcccatttgaacttaatgcattctggaatttaaaggaatcttggtctcttgattaaaagatgatttaaatttaaagggccagacaatttaattaagtgccagttgatgaatgctggctgctctgtgctctcatcttccctttctttttcatgagtctttgttacaagtctcttttctttggctaaccagtgggaatgcatgacccaactccttaagcttaatttttggcttgtttttgctgtatagtctgttttgtgtacaagatattttaatgactttcttcccatgagcaagatttatactagataattgctatttgagggagggagggagagagagagagagagagagagagagagagagagagagagagagagagaaagaacaagcgaacaaatgctagcagggcagaaattttaagctgatcacctcatttctaaaattttagcagaaataagcaagatgattagtttgaaatgtaattcatagtcaatggttaaaacaaaatacttgagttgctgattacagctcagatagatcctaagcatgcaatgagcttctggagtgattccaagtgtcttttgcattcaagagtgctctatggagataaaagaatcactaagatgagtgtgtgtgtgtgtgtgtgtgtgtgcttgcgcatgagcatccctgtatataaatgtgtatgtgtgcgtgcagtatatatacatggagagggaaacataagagtgagggaaagatgaagagaggtaggtaagagggaagggagggggacaggagagagagatagagagagagagagagagagaagatttattgtggggacctcttcacatatttctggaggctgagaagtccttcaatatgctgcctgtaggttgtagaacaggagcaccagggctgtaatttagtcctagcctgagaacatacaagggtagggaggaaggaagatgctgtggaaagcccccttccccagatgtcaaaacaaagtgaaacaggagcatggctgtctggaggcagcagatatgaggcatgtcccaactctgagaaggagcttagatttgcctccctctgctcttttgttctgcctgtgctctcagtgggcatcatgcccactcatgatggtggggtagattataaccaacttagtttctggtctgaaaggtaccagttaattttctcattgttgtgaccagatgcctgacaagagcaacttcaggaagaaagggcttgttatggctcacagtttgagggtatagtccatcatattgaggaagtcatggtggcaggaacaagaggtagctcctcacattgcatccacaggcaggaaactaggggaaaacaggaagtgaagcctggctataaaaccccaaggaccgaccccagtgatccacttcttccagtaagggtccaccccttaaaatttccaggaccttccaagcagtgcccccagctagggaccaaatgaccaaacacatgagcctacagggaacatttaacatctaaaccatactgtgtcttgtcagacagaagaaaagaggaatgcctgcatctatccagctttcttgttttgttccttttcatcagtctggtccccaggctgtgtgtgatggttccattcacatccagggcgtgtcttatttctcagttaatcttctcaggaaaaagtcctcatgtatgcccagagttgagtcttctaagtgatcccaaatctagtcacactgaccatgaagctcacccgtcagagcccatgtctttgagagcacccccagaaagacctagagataatatttccctgggtggtagtttgaataaaagtggcccacataggctcatagagtggcaatatcaagaggttgccttgttggaggaagtgtgtcactaggggcaggctttgcggtctcaaatgctcaagccaagtctagggtgacattcatgactgctgcctgcagatcaccgtttaactctcagctacctctccagcaccatttgtgcctgccttgcttcctaccataatgataatggactaaacttctgaactgtaagccaggcccaattaaatgtttttctttataagtgttgctgcagtcatggaaacctaaagacatcctgggtatgtgggtataccttacccaaccaaactgacacaaaactatcacattttttccccctgcttaattcattcttttaaatgctgtggtgatgcaacacaaactgtcttgaagaatttaagacttttggaccaataagcattcaaagaagaagggaaaactacctggaaaaaaattaccaagaaaagaaataatctgacctaatgtgatctttgaagtctccaaaaagaagattgaatccaagctgggtggaggtcacacacgcctttaatcctaccactcaggaggcagaagcaggcagatttcaaagtgagtttgaggcaaggctgatctacaaagtgagtttcaggacagtcaggactattaaacctgtgaagccagagaaaccctgtctgagagagagagagagagagagagagagagagagagcgagagagagagagagcgagagagagaagagaagatggagcctcacaatgacaatttttccaggattatgacaacactattaagctgaacaccttcaactaaagatcggttttggactacaaactgctcagaatgatttcgtggaggtcaaccgagatgatccaatctcacaaacactgctcagaacaatttggaggtggctatcagagatgatctagcctcacagacactgctcagaacaatttcaaggaggctagctgagatgatccagcttcacagactactctagccaggacttaagacaagccctgcactttcccattatgcagagactggataaaaatgatgcagcttgacagctaaccaaaagttctcttttcaggctctcttaaaggtgtcattgttgcccccagacagcaggaagtaactttaagaacatgatgcccacattctccaagaggtggggtgggtgttttttttgttttttgtttttgtcattcaatgggttatggatatttgtcattgtttagggatactggttataaaatgttgtttgttatggtcaggaagtaagttgaacaaaggggattagattcaagatttttgtttccaaaaaaaggatacagacatgatacgataaaaagattgctgaatctactcttgaaaagaaaaaaggaaggctatagatataatataaaaaggcaggttgttgaatctacttctaaaaagtataggtttgaagagattaaaaggtaaattattgaatttacttttaaaaagcaactactagttttaaatgttttacattggaattgaacttctgtatattgtatatgaatattgtatattgacataaatttgagattaatttgttaagacatattttacatatgtttctatttatcaatgcaatgtaaatttctagttcttgaaagttattattaccaactatataaaacaataaggaaatgtaggtgagtaattagtcaccttctataatttgaacttgtaatcatgttaggtattttttcaatgtcaaacatatatttcagaaagacaggccatcttcaaacacctacagaatatggcatttaaaagttttaataacataggttattttttatgacattgagacatgtctgctcctggcagccccaatataattcagagaagatgcggggcatcgaagaaactcacatagagttttctttctttgtggcaaaggtaagacactgggcaataaaagtgcccttgtctctactgctgacagtatgctgtctaaaatgaacaaacaggacacaaaaaagagtcactgcaaaccttgccaagagaaggcagtccactccttcagaaaatcctgcttcacagaaatgtctgtgagagatgctaggcctataggccaaagatggatgtctcaatgctgcagaggaaccttgggtgactgtccagacagccagctgtttctgtcatttctcacagtttttgggagtcacttgatcacacttcctgtttactcagttaatattatttccttctcaggtctctgagggagttgaagactggatagtatagttatagttttcattgtttaccagatttagaaaaaaaattcactaaagatgtgtaaattgcaaatggtttgagagacattaaaagataatttgaaaatgcaaattagaataggaaataagaacaacagtagacaatgaggtattttctctgaacgtgtcaaatgcaaatagactatatattttttctgaatgtatcaaatgtaaatggactaagcattgttgatgaacttatttactgtatatattatatataattattgtacttattgtatatagtttttcttctattagttgtagccttctttttgtattagacaaaaaaggggaattgtagtgatatattatttatgatttattaaagcttgcttgaggattcagaaagcaaagtcagccacaagccgtagaagccaggtacacacctttaatcccagcagccagaagctaggaggtggtggtacacacctttaatcctaggactcagaataaagagatagactgatctctgtgagttcaaggccacccagatctacacaagagtgaattagtctaaaagagaattatagctcacacctttaatcccaacattaaggaagtatataagacagaagcaagggctcagggaggcattcactctccagccacactgaggagaggcagcagtttgaggcttggtgaaaaacttgtgtgtgggtcagtcctttcagcctgatcttgaggtgagagctagtgtccggctgctttgtttttctgatattcagcttgaaacttgaaccccagtatcggcctctgggtctaatatctgtgtctgggccatttatttattcgtgttacatggtgatgtttctggtagcattgaaacactttgttggtcgtgttgacttctagggtactacgtggcagcagcatcttgagtttttaggtacagtatatacagattaaagagaaaaatactgtgggctacaatggtcctgtctcttcctgatgcatttgctttgtactttctcatctccttaatgcattttttttcttttgaaaaataattattatgaataatttcattcactcacagcagagcagagagcagcttagtcacctctatgcacccaacactgatacttgccaacccgcttttcttccatctgcatccctcctgctttgtcttttcccctacacaggattatttttgaggcaaattcccagtattcaagttgcttcatatgtaaatagctctgtgcaacatccctggctgacctggaactcgctttgtagaccgggctggcctcaaagtcatagagatccacctgcctatgcctctcaagtgctgggattaaaggcgtgcgccaccaccatccagcagccctcccaaattctaatgaatcacatctgtagcatcttctacttagacatggctgctttttgcctaggagccccagttctgcatgcctcgttcatgtgtgttaaatatggatcctcatgattctgggagacgcacagaaaagctttcctctcctgcgagcttttgttcacccgaggaatgaatggaaattcccactgcagggtggaagggttttcttttggtggaaacgtaaaagaatctccaatgtattatgaaaagggaggggaaaaaatgtggtgattgagattgtcggaccagcctttgtggtacttggtatttcatcctcaaacacggatgtgagcatgctctaatgcttggaggtgatgcatactctacatctttatcttgcagaggggggtggcagaggtgggggcctttaccacgtctgcttgctgcctggcctctctttcatacactggaaatgggatgggaatcagggcttgaaagttgggcactctgctagtcaaccacctcttaggttatttcccagcccagtctttttttttttatttctaggaactctatttttcaaagtggtggtttttcccaaggcaatgactttaaggaccctggacgtcgtccagcagtgcaaactcacaggaaacaggtttggctgatgttctgtgctgtgagagtgaggcactcgagaatatcaacaccagagctggaaatccttccagtcatgagagtcagattaaactcgttctgtatcacccatgtcctgttttaaggagagaggaagtctgttaccagaaagagtgctttgggtagaaagctcatgtccagaacaccaaggaccaggccaaacatttccatcattgttaatcctactggaagcaagaatagcttttcatgccccgatcttccttcatgacgaggtgtttgttgatggcctgctatggactggcaacctaacactcatctagtgttttgttacagctgtgagcagaacaaagccttggagacttggatgtcaatagagaataattggtgtgcaaactctatgtgtacctcagaattaagtgctgataagaaaaaaatgttgaacagatattaaattggggctgtcaagtaagaagaagacgcttgtcccaagtccagaatgtggtgaggaagtagactcctgggatatttctgggaagaacattccagacacagggaaggaaggctgcagaagccaagaaggagcctggctgacatgattgaagagcaacatggaagaaaaaggctgaagcagggctgggtagatagtaaacagaaacacagggatgcaggaaggcactgcaaagcgtgggtcagaatcccttattgttttcgtttaggaatttaatgtgaagttgattaccccccctacccccaaacaaatatgaggtttagcatgggtaggacatatagaagaaatgtttgaaatttataagatactctccctgatcagtagaactttgggttagaaataattgcagattgagtgtgagccatttctctatggtgtcagctatagggactcaagtttagcatccccttttggacaaagagctcatgtaatgcttggcaggattgtggccttgaggggagcctggagaaagcttatgcttgtagctatagagtaatttaggaattagcattggattgaaacctttgttggcaataaattttaaaatgagctaatttgctattgaccattgtgattagaataatcgccccattggaatatgtgtataatagggataaagggaattatagctctgaaggctgatgcatccatttcctcctatgaatagttaatgctcttgtcccaggaggacagtctctgcacacacgctagaatctgcagatttaagctggactaggcatgctggtttgcaataaatagtgacataaatcaggcaaagagccagcacagttttgattgggagaattaaagtcgttgggtctactttttacaggcagattgttcctatgattcctaatgtgtgttccctgtgcgccaagaggaaacttcattgaattttatttatgagtaacttatttggtattgggttttcattacattctcacagcctgtcttgtggtttgggggcttttttattatgcattttatgattatgaggtgtacttgcaaaaaagaaccttgggcaggagtaagagagaagatgtaatctgccaaacaatgacccaaaccgatatatcctttgctgatggcgtgaatctgtggagtcctgtttggaaaggtgattcaaataaatttttccctctagagggaaaagtgaccatctgtcctaatacaatcaccctcacccatctcacccattcacccacaactccactagccccctacccatccattcttctagccatctattcatctactctgtcaacccacccatccatctacccacccacctacctattcatccattttctcatccatccatccgtctatcatcttcctcctccctcactctattcctctcatagccaatatcaatcataggctgtagttctgggacctggaaagcaaaccaaatttccaggcacacatggaaatgaatccacagcgcatggatggagctaatcaccaatgagaacttagaaatggaaggatgacagagagactaacatttccttacctagggtgggggagcatattcatctcagggacctcccttcatgcctatgcacagacctatttttaattttttccatgatcacctgttttatgtctctaatcaatttcataataaagacattagacattttttcctggaaatcaaagattgtctaatcattctctcaatacacatgtgtggacatatacacaggcacagggaataccatgaaatcatttatacctgtaggttattgccaaatggacttggagaagattagaaaaatatcctcagaaaaatagaatgactgttttgtggccagagtcaagaagaggaaactggcttttcttggtgttgtcaaatggatctgctgggttaaaggcttatcaattttcatggcagataggttactctggaatgcttttgatttccagaagaatgtattgtggaatgtcacaccatgtcataaggtttaaaagaaatgtcttacttagatacaggatatctaaagtaatggtatagtaatagttctagcaatgccctgttttctggcctacatgcctccaggctgtcttactatgctagacctaacttttattctgtgatactaagaaacacatttccacactatcaaagtcatagcttacatagcccatactgctgtgttctgacatgagacccctgtgttctgtggctagttgtgttggattcatccatggccaccactggtgggcattgtcactgtccctatgtgtccagatttggtcttgatgaggcctctcagcttatacctagaaactatatacctcctggtccagactcagttaatgttcccatttggcaccttattgtttatgtagcaactttcctctatttattgatattttactatttgatatctatagcattcttcaattctgagattattttaaaccattttccccttagagctatttgactccatgaacacagacttacaccatgtcttaaaagaagacatgtgaagatttaactccattaccccaaccccaataatgtttaggtcattcattgctttgctgcgtgctgcaattttcactcacctctggtaaagatcacttcctttagcatctcactttaaatccagtgatcatggagttcatgtgggctcctggtactgccatgatatctggcttcacaaccatggtccgttcagtctccccaattcttttataaaaaataagatttatttttaatattttaaaattatgtatacatgagcatgtctgtatgtgagtatgtgcattgagagcaagtgccctcagaggccagtagggggtattagatcctttggagctggagttataggtggttttgagcagcttcccaagaagggtgctgataatcaaacttggattctctgcaagagcaatactcactctttactactgtgtcatctctccagtcccaggttccttattctttcacgatattcataccttttctgtcataatctccaacacacattttgccttcttttttcaataaaagcataaagaattagaatagagttttcttattctcagcgccatgtcttccacctacctgtttttttttttaatgctgcagagttcactgcctctcacttatgccaaagtcacatgtcatctctccatgttcatttaaagatgaatcattgcaaatgtgttgtgatgtttttccctgataaaacgtcaaccgcccatctcctttaaactaccatgtaatgtctagttctagaggaaaccttagcccagtgactcacaatgatctactcggttcctgaaactcctcatttctttttcttgaatttctctgggaatctctacaaaagtagcttagctgagatgactggccatcttctctcgcagcccagggtctgattctctggcctaccttactcctcagcatgtttgatttggtccactggtctctccttcgttgtgttgattctgtccaatcttcccattgtcactgttaactctggtgtttctttgcctcacaggacatctgtcaccagaaatgtcctcatttttctacttctaaatagttcagtacctcagagcatgtcacagactgctagcttgtatggttttatggctttaaatgttacctgttgggtttttagcccaacatttatgcctaagtatggaattctcccacaagctcctcacagctgactgtccacatcacattttcttttggctccctcaaatattacatgtccagaactaaactgatccccagcttttgctgtctagccttatagtaaccacaagcccatagttacaatttatcagaccctaaattttagcttgtcctagaatcttgttgcatttatttaacccactgcaagcccttctggctctttcctgaagatggaggtttctatcctgcctggtcctgtagccaattctcctcaaataaacacacaaagacttatattaatttacaaattgttggccagtggctagggcttcttactgactagctctgtcttaattattaacagatttctattaatctatgtatttccacaagcctgtggtttacccataatctggcatgttactccttggatatcaggatgtttctttgccatctatctttgccttcctctccccagccatcttgtcaggtagctccacttatgctttctgccaggctattggccaatcagtgttttattcttcaaccaataagagaaacatatatacagaaggacatcccccaccacttttcttaaatttcatctactctttcaatctctactaaagtcattttcttgtaatgaacaattttctaaaaaggctgattcattttacatttccacagcatttaggaagttttctctaaatcttagccaatatttgcttttatgagacatttaaaaagcttaaactaacattgtgcctatgaagagctgtcttagtgttatcttaatttactgaattcatttaatttattactgaatggtgttgatcaggttggccatcaagtttaattgctatccattctatttctagctttgtaacactattttctaatataatgcaaaatttacttattgcatttacttgctggttatttggctccctgaaaatcttttacccagtagaatgtcatcagggagttttctctgctatgcttgctgctgtttacttaaagtccatattctttagcaacatcaagatccttctcaacctgataccagacatctcctcactgttagttaatttctccccatcatttgtctaatctttcagcaactaggaacaaagctccagagtattggatctttcctatgcagacttttcatagatggtttttttaagtcaaaactaaaaatgtaaagaaggcagggagaacagagtcaatgttatcaccacagttcttgctggtgccctctgtgaacagcacaggagaggccaggaggcgagaggagtaaacttggctttctcttactttctgtccctgagggacctagtggtgtaaacatcttggtgtggcagataggagtctgtttaaagacatgcattttgtatgcagcctagtctctgagaagaatgccaactgcttgatatggtatgagccatctgtcccagatctgtttggcaagcatctttagagacagcatacacttctccaccacacagactttgtaaaggagtttcaaggctgacttttaatctgtgtgattgtgcttcattttctgacttttgaacccagcttacacagcaggatcacactgtcatctgctagcaccaaggtactgtcacaacctgtttccagggggtatatctaacatatatgtctaattcagaaaggcaaatgctctatgaatgaatgtctttgtatgtggaatatgaagaggttgatcttagaaacaacattataaaaggagtgaagagatggatatcgaaagggaagaaagatatcaaatactgccaagcttcactttgctaaggtctaaagagattcttttgtgatctgttacattggatagtgaccacagttaattatatgctgcatatctttaaattattaaaataagctgtatgtatttcataggcttgtagtctcagctatctgaggggccaaggcaggaggattgaatattcaaaaatagctcgagctagacaataagctcaaggctagcctgggcaactatgtcagtctgagttctcaagaggaggaatattgattgatttaatacatattaaaagtggatttattaggttggcttacatgacacacacacactaggtaacccaatacatgttgtgggtgaccttgcttggacacctcttggggaagggggtgagacaatgcagcaccaaggactcaggccctgggagtcagtcagtagcaaagcatgctgcagacttgtttactaaggaagttagacctgcccttatacaccctcccaaggtcctattggctcatgtggctgactctgctgcattgtcttttcctattggtgtctttctgtcagcagtctctgggaagaggcaggcttggctcagggaggaggtagctgccaggcatgctcatgcaggctggcctggacacctgagtgggacgactgtggcttgggtaggctggccggcagtttctcctacaaacaagggctatcttcacactcacgagtctgagaaactggtaggtgcccagccccaaaggctggaagctttagcagtcctaatctagtgttggaggtctagagggttcctgagagctgctggccttcagtccatgatagaagttggaagaatgtgggctctgatatcagcaaaggaataaacacatcagtggtggtaacagcagcagcagacaggatagataaacttgccagagagagacaaaggcaatgaggcaaaaaaccagagcttcccccttagacttcctttatctggtctccaccagaatgtgccacccacacttagggaaggttttcccactgctggaaaattctccatagatgtgccatctgttagttggttccagatccaatcaaattgacagccaccattaatcgtcacagcaacttaggtcttgtcttaaaacaaagggttaaaaatgtgctgagctatacctcagttcacaggtcagttaccaaacatgctcaatgccctaggttctattctgggactgcccaaataaatagataactaagtcaaagttttaaaagggaaggggaaagtagatgatttcaagtcttgtgagcaaaggtagtggtacttagggaaaaggaagcttggtcagcgcctggctcctgtgggaagtcggtagacggaattgctaatgattgatgggggaagtccttctgtgtatacgtttgtcttactggttgataaataaagcactggtggccaatagggaagcaagataggtggggctaggagtggaggaggattctgggaaatgtagtaaagaagaaggttaccatgtgaccctgggaagagaggacacacatgtctgacgccctcagtaagataagttcttataaaaatatatagatttatagttatggtctatattcaagacagagctagcaaataagaaattctagtcattggccagctctgtccaatataagactctgtgtgttatttggggccctaaagctgtggcagaacccaggcagcgggcagaaagagttatcgttacaaatgatggtctccaggggatcagtggttccttcatctcagggagcaaaacatggagatgggatattgtggagaatgaagcaccggctgatttatcttgggtgcaggaaagattttccatttgccagacaacttctagaaaggagttatgggtcaccgacttggggaactctcaaccttattctctctggaacagtgtgtgccaacattttctaaacatgttctagtgttatggactgctaaagggagtttctcaaaataaaagctctgttatcaaatgcttctcagagccacccatttaaccatgctctgagagtttccatagcaaaggtctacatggggcatgcccacatgttatgctttgtgagttcccagtggaacaggatctgaaaagggaaaagagttctaaactatattttatcacctaacctagttttaaaagaggattcttttaggattggtgtattgtatggctttttgttttgttttgttttttgagactggatcttgctacatagtcttggctggcctggttgctccagatttttaagatggacaagagggcagataaatctgtggatattgatgccatattctaaaattttcttgcatgttaagactttgtgaatataaccacacgaaattcaaaatctggcttaagatttctttagaaccacttatttaacagttttataaaaatgttctcctgagagctgccctagactgacaacaaggctgtcaatcctcctcctggtttctgaacacatgccttgaacagcaacagcagagctgcggtgagaagcctctcagtgggcttttgctgtgaagcatatggctctttctgaatgttcccaatgaaacaagagacagctccaaggccactcaggaggtgctgtgacctgggaggtgtgtgttacctagaatagttcactcagtaccctgaaggcttctctgaaagccctaagagtcacgtagctctttacatacgtgctgtgacacatggagattattgactgaaggcttgggagccacagtaacttaactggaatggtccatcagagaggaggcatgtctacatgtccttacctcgtactttgaaatgaggccaaaaaaagtggggaggagtgagaagggccatgctgggagccaaacagtgtgaaatggtgccgtgacaaccatttaacatatgtgagagtaagtttatatcaatctagaccctagaggtatctggtcagcagccaaaacaccaagtcctaactttgtcctcctctgggaaaggcatcaaatgcaggtgctgcagaaggatacctgtgtacgtgaacccatgagggattcactatgcacacaggctgtttctcagtgactgcgggctggtgtgaacacagaagggttgatcttcagtgactatggggctggtgtgaacatgaaggggttgatcctcagtgtctgtgggatggtgtgaacatgaaggggttggtcctcagtgttttgggggtggtgtgaacatgaagggctgtccctcagtgtctggggcattgccttagtgttatgcaattctccctcttttcctaagctattagtttcaaaaccttccttgaatactaaatccacagatgttacagttccttgtataaaaccatccacttctatatttgtgtataaataatacccatactcttgtatatttcaactcatttttggatcacttccaataactataacaatgtttatgttttgtgtagttgttataaattattgtttaaggaagaatcacaagaagtcaatatgtgttcaatacaaacacaatctttttcaaatattcttgatccacctttggtcaaattcatggaggcagagcccatgggaatggagggcagatgaatatatgatagggagaaagaaagagactgggaaggaactggttcatctcactgtacaactggaaagtttgcagtcaatagagcagattggaaaatgagaagggaaaggtttttctgttgtagtttttggcagaattactgcttcctaaggaaacccagtctttcctggcaagttacaggatgatggtaaccttcttcatttaaagtctcatgaatatagtttatgttcaggaatgacttcacatcaacatctagacagatgcttgacaaaactcttgggctccttagcttagcctagttgacatctgtcattaatcacatggacaagctcttacaatggtgctgtcaaatctgtgacagaggtttgctctgtcttaaacaaggtgagttttctaaggatcttctgtcttgagataagtggtggtcaaaccacatggttggggagagagagcaaagatctctgtccttacaaaggtccaactccagaaagcctcatgactcaagttctgtattgttgggacccagcaggaaaggttatcaactgacctgattcagggtgagctgtggattttagctgctctatccagagcattgatttatctcctcaaaatgatctgttacacagggttcttgcaagagatggtgagaacaaagtagggactcccagagcttagaagagcaggggcacaggacaccttttgtctaacttgccagtagatgtttgcattccagcataggtttgcaaaggcatactttcatcatcatatatttttcttttttgggtgtatggtggtggtgctggtggtggtgctgctgctgctggtggtggtggtggtggtgtgtgtgtgtgtgtgtgtgtgtgtgtgtgcttatgtttggaggctagaggtcaacataggtgtctttattgctctccaccttattttctgaaacaaagtctttcactgaacttggaactcaaggattcagctagtctggctgaaccatcctgtatcctagctgaaattacagtggtgtaccactacgtccagggttttacatgggtgctggatttacccaggtctgatgaacacttaccccctgagctgcctcctccacctctcactgttgtaccttatcatgttcttattgccaagagctgcaggcttcacagactctggcctttgttacatggccaaaccatcttgcttcagttcatagcaggagtatagaattctctgttataaagccattgctgggtgtgtgggttgggtcaggggagcctgggatctcctctagtcagttgactgtcatccttttgatttgaggacttaggttagtcttttggacactgtagatttaggtccttgtcataggttgctgaatgctggaactattgcttttaacaactgtgccctctccatctgaccctgtagttgaacgttttcctctgtgtcactggtctccttagactggtcccgtcccccccccccccgcttgagggttcccatagctgcttataaaataatcactcaaaggctaaaattaaatatcattgtttggccagtggttctggcttattaccggctagctctctctcttataaattaacccatttttgataatctgtgtatcaccatgtggttgtggcttactggcagttttctggcatcttacctttttggtgactacatggcatctccatcttcttcctctctctatctctgtttggacttcccacctagctgtattctgccctgtcataggccaaaacagctttatcaataatcaataaaagcaacacatatttgcagcacacagaaggacatcccacatcatggccccaacccatctaaatctttaaaactcttaaaggcattttctaggaagaaaaagctttcatttagtggttaatgttagattttcacatgactcctttctggaattgtaacgttcatataaattttgcaaagttttcaatgacttgtgttcccttaagagacagtgttgatatttttgaaggaaagattgtttttgtttattttgagacagagtttcattatgtagcccctcctccatgtgcctctggagtgctggaatcaaagacatgtgccaccacacctgtacgaaagcagtctttttgaagaaaacattttccatgctatcaaagagtgtacataggtgtacaaatgtctgaattaagaaaaataaagatatggaaccaatttttgagtttttactagcacatattaattacacataatgagtttcactctgacatttccaagtatgtaatatgttttgatcatattcatctgcatcaccctctctttctcctcctgcctatcgctttcctcttcccagctgcccccttctacttttgtgttgttttatgactagatgaatttcactaaggtggcttgtaagaaagagcatgagaaccttctagtggctacactactgatgaaaacatttctccctcccccagcaaccgtggcgcctataggtattagaatatttagaaacacaaaacctttgctagattttgtttttagcttagtaacattttcctttgaggctgtgtaagcaggtgcctgtgcaagtcaaagtgaagaaggctaagtgagtttcctctgaaaacagctcttcagccaccccctaagaagctaagtaatccatcatactttatcaccttgtactcagaagtaggaaagtggatcttgtccagagagatacattaggttttgatttatgagatattttgcttttgggtgaatatgctgattgacttggaataggagctacctgtactgttaacaacagctctcccaaatcacgcattctaagatgatgcttgctagttctaaggttcctttttatataatgtggacttgaagtaagctaagatccttctgttacattggtctgatggattgtggggaattcttatctgcctgtaggagacttggccctcagctgctcctatcttcactttccaaactctttcttcttgttgacttttagatgacaggacaaaagtgccatttgctaatgtagagacatgaatgaaaaagaatcctcaaattagggtgcccagaaattttgataacaagtgttttcctaaaataggactgagcaaggacagaagcctactctggagcaaagctgttaatgcatgcaccccagatgtgtgccagccgggtcttcattgcctcaaactccggtttctctgcctcactagagctcaccccctaaggtgtctcttgcagatttaagtgttctccacctggtacaacattgtctgatttttttctggggtattaattactttccatctttttttttgtgatcaaacagctgacaaaaaaacttaagttgggaagggtttattttgacttaaaggtcagggttacagttcatcatggagaggaaggcatgccagcctggtgtgaggtggctgggcacactgcacacagtcagaaagcaaaggtagaacagaaaatgaaacctggctgtgaaatatcacttcccaaccacagtgacttacttccctcagtgaggcaccacctcctagaaccttccaaaatagcaccagcagctgggaatcaagtattaaaacacaaaccggtagggccatttcacatttaacctgcatcacatgctgatatgcctgtcatctggctctgcactggtatgtaaattcttggacttgctctgttgatgtattcctggtgacatcatggggggactcgaattaccagatgctgggaaatatttattgaatgaacagaaaaggagtgagcattctatattatggtaggataacaaacccaggacttgtgagttaatggacctaaaatttgagcagtcagaacccagtatcacactttaaacagtgttagtgaaaaatacaatactctaaaaaataaattgccactttgagagatcatgacaagattatgttacttggggctggggttgtagctcagttggtagagtgcttgcctagcatggaaaagccatgggttttacccccacataaaactgattgagcgtggtggcacatgcttaatcccaatacttgaaaggtggagttcaaagtcatccttagccacacagtgggtttgtggctggcagaggatatatgataccttgccacaaataaaattaaaaactggtgctactgggaagttggtaaaagaatgtaatgtagatttcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatccctggagtacatgcacacgtctgcccttttaatgctcctgcagcacacttggtggttcacgttaaattaagggacacactgattgacaaggctcacagtcagcagctgtgtcttgtcatgtcagagtgtggcctgaatgtcagcaacttccgagttccatatcagaggatggcggtgtctatgcttaactggagagtgactgggtggtgctcatgttagagacccacagctcctgaaactctgtggctgtctgaccttcctgtcactgtgtcacctctgttggcagagggtatttcagccaactgtgagtcaaacaatggaggtgctgacatggccttccatatctgagaatggcctcagggtccagagctacaggaactatgggaggaagatagattgtcaaatgtcagcttagaactagcggtccctctcactgttaagttgaacttgactaaatcacttaatgtctttgagccatgttttttttttttttttttcatctggaaagtaggagtcattgtaagtttaccagaaaggcttatggggcacactgttgggggatagataccttatactataaagtatccatcttataatactatataatctacataatatataactaccttatactgtctaccagtttcagcttagttattaggctctttgttttctttatttattgttttgttcggttcttcacctttggcatgtctaagtcttaccctgatagcacacatggaatctatcatttgaaagggaacttatggttcatctgtttaaaactctgctaccattcctttctaaaattcttattcttgccgggtgttggtggtgcatgcctttaatcccagcactcgggaggtagaggcaggcagatctctgtgagttcgaggccagcctggtctccagagcgagtgccaggataggcttcaaagctaaacagagaaaccctgtctcgaaaaaaccaaaaaaaaatttcttattcttaaaagacacacacacacacacacacacacacacacacacacacacnnnnnnnnnnnnnnnnnnnnnnnnnnnnnnnnnnnnnnaaaaaaagaaaaagcagagagagagagagggagagagagaggaagggagggaggagggagggagatacacacagagacaagtgcaagcacaaacataaataaacatgtacaaagacacacaaaaccatattgttttctacccccatccccatttctggttgtaaccaaagaacaatgacaaagaaactttcattactgaatactccctggattgtcatgaagccctgtgatgtttcacatttataattgaccaaagcctcctcagtgcagtactttgccacaatgctcaggggtggcaatgaacccaaggctctgaggaggcttgctaggtcgttacattatttgtagctgactaatattttcaactcaaaatggtttcatcaaggcatagacactactgtaaggcaagggacacctgtaagtttatatttctaagcaggactgctgttttgcttatttgtattaataataaaaagaaaacattgttggaacagcaataacctactctagttaactcaggtcagtacttttttaaaaattgctctagtaaaataaggaattattttttgaagtgtttatacccaataaaatatattcatcccgacaacagtgttgcgcaaatggtggagaagaaaccctcggttcgttcccaggaccctggacagcggcgggtgctggaccgggcagcccggcagcgacggatcaatcgacagctcgaggctttagaaaatgacaatttccaggatgacccccacgcaggcctcccccagctgggcaagaggctaccgcagtttgatgatgatgcagacacaggaaaaaaaaagaagaaaactcgaggtgaccatttcaaacttcgcttccggaaaaacttccaggctttgctagaggagcagaacctgagtgtatccgagggccccaactacttgacagcctgtgctgggcccccatcccgaccccagcgtcccttctgtgctgtgtgtggctttccatccccatatacctgtgtaagctgcggtgccaggtactgcacagtgcgctgcctgggcacccaccaggagaccaggtgtctgaagtggactgtgtaaacctggcatcagggagaggaagtccctgcaaccattaattaccccagaccatccccaaaggacagagagaggagctgtccactcacccagcaaaattgtccccactgttgtggggttgttcagcccacagagcgctgtgataataaatggcctcgtgaaaggaaaaaaaaatattcatcattgttttcataatgagatagtttaaactcacaacctggtttgaatgaagttcaagagaactggttaaaaacaaagccagaagcttaggagattgcttcgtgggtatcatgcttggtgcacaagcacaaagacctgaggcattcccagagcacacatataaaagacaggagtggtgcatacccctgtattaccagggcagggttaaggaggagtaaggaggattatccgaggctctctgaccaacagcctagctcaaatgatgagttcctggttcattgagagacactatctcaaaaaagtgaatgcctgatgcagacttctgaataactgatgcacatggatgcatacacacaaaaaactcaagattgatacagagagatcaagttttggttctccacaaagcagaccttcaaaaggtcagtgtaagaacaccatggatgctatctgcctttaattctctaatcatcattgtgtgtgtggtggtgcctctcacagaagaaatttggcctctggaaaaggggggcagattatgtaagattacaaaggctaattgcaagataatttgagtcaccattgatagaattagcgagggtaaagatgatggcttcagagtttcacaattgtttaatgaacctggccctgtgactcaattccaacccctccctgtttcattttctgtggacagcagcagaggcactgctgtgcggatcaaatgggaatttgcttaagggcctggaagaaatttagattgctgtgttctgtgattcatgcggcaagtaacttaactcataaatgtcttatctgagggctcaaccttacctcatacaattggaagtctgaacagttttctcataaatgtcaagaaagggtggcacaatcaggtgacagatggtgggtttccagtgattaaaatacttagcattctttaatagctttttccaataatgaaaacaagaaatgagtcttaaacatgttgactcccctgagcaaataaatcattatactcatgatagaataagtagtaacaagcagaggatgttagggtagaatatcagactaaaacccctgtatcctcattaaaaagccaccaccaccaccaccacctccaccaccaacacaaaaccattccctacaagtgtcagttctgccaaactatcatgagtattcaaactatcttcagtattcaaaatctaagaattagcttcttaagcccatgttgccatgtgtcaccagtatcagaagtagaaaataacctcagggaaaggtctcataaaaacctacaccagggcttccaaatcacacagtcctagtcactaactttcttcttaacccttcacatttctattgatgtacctatgtgttctcatggtaagaaattttaatatagagtacattgtgaagtgttatggaaaacaataataacaatgacaaaccaggtaaccaactgtcaaccaactaactaactaactaaccaaacaagcaaccaaccaatcaaacaaggaaccaactgtccaccaactaactaactaaccaatcaaacaaccaaccaaccaatcaaacaaggaaccaactaatcacctgaataagcaactaactaaccaatcaacccccaatccaaacaagcaagcaaataaataaccaaccaggtaaccatctgaacaaacatagactctaaccagctaaccagatgggaaacagtgagttaagggtgacaatagaagtgtggtgtgctggacatacctagaggaggtccatggtggagatgtagttgtgtggagagactccacaagattccttgaagaaaagaaagtgagccttcaagggtgagtaggaggtctgaaatccctgtgactcatttgctcaaagtcactgactctcccgctgcagcaagcacacgtgcgcagaggtgtcaggtggctgtgcacatagctctgtctctgagaggttctgagaggaaggaagcagtgtctgaggagaggtgggacagacaaaaactgaggggagagcaaatcctgaactgcaaatctggctatgccctgggtctttgcctcatgcctgttgggcagccctttcttaatgatgatgtctgacataagggaagggtcatacatctccagaaggttggggctttgaggaaatctaggaagtgtagattcattcaactgttgccattgtcagcttggcgtcttcatctaggcaggaagggggagacttattgtcaacactttcccttagattgataaattggagacagacagctagagcttagagctgccaaataaatctttaggattgaaatataactgcactctgcatcaaactaggaggaatgacagcgtaccctaactgcactggcattgcttttggagttgaaacagtgagtgatgccagaagcttattttttatctttgtgggaaggcagcaatctacagtgggtggagtctgcatcataggggagaggccctccttggtgcccattcacctcattgatggccactcattgcctatgtctggcgtgcatgtgtccctggatgtccatattggtcttgtctatacatggctggagggatatgtgtataagaatcactatgtttctgtgtataggtgtgagcacatatccatgtgttgtaatgtagttgtatgatgtttatacctacaagtgtacctagttgtctatgtctcatgtgtttgtgtatataccttttgtgtgtcttggtacattcatgaatatattgcatatctgtgagtctgtaagttttattgtctgcatacctttgtgtgtatgtgtgtgtggttgtgtgttgggtgtgtatgtatgtgactgcttaacaacctgtgtatatttgtatgtacatgtatgcatttgtgtgtatgtctgtatatgtgtgtgcaggtatgtgtatgtgtgtgtggtcctgtatgtatgtgacttcctgtgtttgtatgtacatgtgggtatctgtgcgtgtgtattatgtatttgtaaatgcttgtatgcatatatatggagtatatatgagaggagcatatgtgtatgtatgtatatgtgttctgggcatgtctgtgtctgtctctatgtgtttgattgcctgactactctctctctctgtatacacatctgtgctggctagttttatgtcagcagagacaatgtagggtcatgtgtgaaggactcttaatcaataaaatgttttcattggcatgtataggcaagtctgtggggcattttctttattgatgattgatgtgggagggcccagcccattgaaagcagtgccacccttgggcaggtggccttgggtttatgagaaaacaacctgagcaggtcaggaggagaaagccagtaagcagcactcctccatggcatctgtttcagttcccaactccagattcttggccttgcttgagttcatgctctgacattatccttcagtgatggactgaaacctgagagttctaagtcagtaacagaaactttaactaagacacttctctatgtgtcttagttatttgtgtggagggattgtgtgtatgtgtgtgtgtgcgcgcgcgtgtgtgtctctgtgtgtgtgtctgtgtgtgtttctgtctctgtgccctagaagttgagctcatagaccctgaactgtattttccctatagtcatttacagcgtgaagaagattcctacctgatcagctgctgggtcagatgtgtagctgcctgagtggcatctgcttggttctcttggtttaaatctggtcagtgggaagagtcaaacaggggcattgagataagatatttatagccctgccactcaagaaccccaccccaaaccagaaaagcagttcatgttgaacaatccttgccatggcattggtgagtgtcacacccttgactttcataggctgctgaggtaggctcagccagcactgatcaccttttaaaatagctaggcactggattgctgtatagaaacaaatgtcccatagtcagaggcagaaatactgtggcagttttggatgtgccattagcttgttgattctgttgtctcttcccttcctagtgtgattaggaacatgctcatcagcctcttttctcagccacaaatactctgtgtttatcttggaaaaatgcttttttttcctgggctctcacattgtgtttaaattctgtctgaatttagttggatgaaataagctataattttttagacagttttgtcaaataagccataaaaatgtttagccaatttttgatccccagtttcagagctgggctctcctccagtccctcataccccaggaagtgcagacggagctcagtggcatatttttgcctcgttttctaactttcttcttggcagatgtgtgtgcaatctcaagaagcagcatcataaatatttaaatccaacttggctaattggggaggaagaagggaaaacacgagaaaggtagaatctgataccagggaagcattgtgactattttcgttttcaaaattgttcttgtggagcttgggcattttgtgatggcctctaatttaatgctttagaaacaaagggaagtgcagatcagccccctgtctctgtaggcaggggcctgaaaggggagagctgttgattccatagctcacagctcacactgtgaaatggtcctgccatcccttgtcctatgagcaatgtgactcgttctcatgggctttcagaaacactgctccctgcattcactcagccccatagaaacctgggtctcctcaggccctaaagagaggaagagctaatggctatgagctcagctctggatccactgcctgcccctctgtccatgacttctaccagcatcttctcaggatcctaggcagaaggccgctccatagcagggtgtagcaataactctttctgccagctgcctggggtctgctgccactttagggccccaaataacacacagagacttaatattgttacaaggctgctggccaatgactaggatttcttattttctagctctgtcttaagtatcaaccataaccattaatctatatattttataaagacttaccttgtcgaggatgccagcggcatgcgtcctctcttccctgggatcacatggtgactctctttactacatttcccagaattctccttgactcctagtcccccctatttgcttccctattggccaacagtgctttatttaacaaccaataagataaacgtatacacagaaggacttctcccatcatcaggctacaactgatccttcctggtctcatctcctgccgctttccttggctgctcagcatttgaagagcatcaaatggcattcatattaatgactttcctgagggctgcaaaaaaatacctagcaaaaacaacacaaggaagggaaggattatcttgactcaatgtttgaggatatagtcagtcacagcagaagtgtggggtggttggtcacagcccatctgccatcagaaacagagacatgaatgctgtcctcagatcactttgccctgttcattccaggaacccagcccatgagatggtgctgcccacatttagggtaggtcttagattcttggtcatacatctctggagacgccatcgtagacatgcccaggggtatgtctcctaggtgactccaaatcttatcaaagtgaccagcagaattaatcatcattgctctcaggtgttccatggtggcgtttccatattcctgttggtgtcttcagcctagaatgctatgtgctatataatcagtgtgggctggaggtaagtctgttttcacttttataacaaattgagaaacccgtgttccgaggccagcatgaatcagtgatggtgggagcttcctccagctttcagaattccaacttcttacatcttcacatcataaaagagagcgagagaggtttctcacttctcactaaactcatcccaagcgttccccccccaggaccaaaacagaccccaaaggctctgccttttaataccaccagaagggtggttaggacttcagcatgtggaatccagatgcagagggatcagtcataacaggtattgcgtaatccaggagacaatctgtaatctgtaagatcgagatatctttattgagataaataccagctaaacgcaagccagagcagcgaggccagagggacggggaaggagaagaagaaggggcttccttgacaggcgcagtcaggcacacctgcagccagcctctaacaggcgtggcttactgttccctacaaacagggattaacatctcagccccagcaggttccacgatcagcatctaaaatgccagcatcagtgacttgttccttcacactcagcctgtcttctgctgctaacacatctcagaacacaacctaaatactgaaagcctctggagtgtgactgggctttctaaccgctttgctgctaggaggaagtaggtaccttggagacagacactgacagggacaggaagaaagcagggtctcctttgctacattctttgcttaggccagatgcaactgtacaaactcagttgatgtagaaataaaacatgtgagtgttgagaagagtcaggaactcacccagggctctctgttaagcccaggactcttatcaagggattccatttgtctaatttgcctttcattcagtaagaattttcaaactgccagagatgggtaaaaatcaacatagaggaactaagtggaaattaatttgtccttcatgatcatacctttcaaaagacgacatgtgctccccacttagctggtgctgagcaggaaaccacagagtggtttgcatggatggcaacatttgctttgtgtgtgggtctgccacttgggttggatagggtgggggcagctcttctctgctgtacatgcacttggcctggacacaaggtaggctggaattggcagctctcggnnnnnnnnnnnnnnnnnnnnnnnnnnnnnnnnnnnnnnnnnnnnnnnnnnnnnnnctctgcaggcttctgcttcctcatcgacagacaaccaagcccagggtgggcatgctgagagaatggtcgggagaccctccttaagacctagtgtaggaaattatgcacagtgaattctgcacattccattcttctgggcgtacagccccatgcatatttcagaaggaacactggagaccagaaatactgtgaggctgtttatagaaactacagtctgctctgttggaatgagaagtcatttcaattgacttattgttccccatgttcccttccatcctagggagcagactccttcaggtgtgttctgtggtgggcaagagaattctttatgttctggggtaattaccacacacaacttcctccctaatgaatcctgcccttcttctctaacctctatttatcctacaggaagaactcttacacatatgaaaactagacccatgtggatttgagattttattacaacagcctcggggatagatagccccacagactattgggtaaggttaaatttagacctgttcatcgtggctcataatagtttgtacacaactgtaagatgtacaagaaatgggagaggttgatttaggctcacacaagctcacagcagtaaccaagctcacaaagtcctcacccaaacatctacatattctactaaagaagctgcctagaatgtattgatttgtatatattaactcaggttgtacccaattaagtagcattgttttagcaaacctatctctctctctctctctctctctctctctctctctctctctctcttccccccctcgcccccccatgatggatgtgcacatatgtgtgcagtgcccatgtctgtggacaccttgatgccatgggaggacatggagtgtcctgcttataactcctgacttgttcacttgcaacagtctctgactggacctgaagctaggccagtgggcagcaagccccaggccacctcctgtctctgtcccccacagcactgggtcacaggcactcacagctgcacctgactttatatggatgctggggatctaaattcaggtccctgtgattttaaagcaagcactctttcctgcttattccaagcctcttctctttaaaaaaaaatttaaatgaggaaaacctcacatgaattcggcatttagaaaaaatactaaggtgctttcaaattatacaagagtataattgagaaggtagagattataaaataatgacactaagtatttggatatttgcagtgttcccaagggttcctttcttgttatctgacccactgcaatcttcccaggaattctttctcttcacatgactggaaaatccccaactgaaaagatagggtcttggttccaccactagtcagctgcacagtcgtaagcaagacacaccacttctttataggccatttttaaaatgggtcatttgaccagcccatctccaatatttctctacagatgatatacaagaatgacatttactaatagggggtgttgtacactgaaacagggaaaacaataagaagaaagaaggttttcttttgatgttgaattacaaatgatcaaagccatatatagaaatggcatgtgtgtgtgtgtgtgtgtgtgtgtgtgtgtgtgtgtgggtgtgtgtgtgtacacacaaatatgtatgtgtatgtgtgcacatatatacatatatatatatatttctcaataagttgttattcaaactctctgaagacatttcaatacagagtttgaagaaatggatttaggatgtggttggccatcctttcaccacctatataacctcattataattggagaagcaaaattaaatattatttcataaaggcaaaaataggagagtgtttttttttttttttcactgtgagtgggtcttaggaatccttgcaatgtcaaaagctgccacactgccctggcaggtgagaagaggcagagctttgccctgcacccaatgttaactccaaggccacctttgggagagttggtgattctattaggtctaatgtgggcactttttcattaaatttacatttatagaatgcctcctgtattttggcagagtcttgttctgtagtctggctggcctggaactcacagaaatcttgctgcctcagcctcttgaggactgagattataggcacgagccaccatggctgactcacaccacctcctctgaagtaggtctccagtatttgaatctctactttcaaaaacaaatgtcattaagagaattacagttaccagagtcaatgcttagccagagcacctagtaaactctaacagcatacccatccttctatttaccaaacactctttggctgtgaaaacaagatgttagcacaccttgactgagtcagggggcttttatatgtcagctacagtcctatgagttaagtaatcatgaccttgtacacttcccacgttagtgacatttctcagtgcaactttgtagccacaggtaggttctggattccaattccagcttannnnnnnnnncttcagccttcattgtgttgaaatattttcaagggtaagtgagtcaataatatgaaaatactatgtgtgggataggaaacattaggtacacgttgattcttcagtaacaattatttttactgttggcttgaccctgtggacgatacagaaagggctggctttgaactgttaagtaacttgctctagtacacacattgtaacagaattggaaagtttattgtactgaatatcaaatgtctcaacttctaatctttgttattgttcaattgtacatttaacacagagagataatattatttttgttgtgattaggctgaagttggtttctataaacatttctttaaactttttttaacattattgttatggtggaagctccaccccagcccctggcgtccatatacccaaagagtctggaatgttatggtgcaagttctatccaagccctcctcccctctctctccaaaccctgcttcatctcagaaagcccgccaaatgatgacccctcccccagaggtgctcaagaccactcccccagggtatctaaactgtaccccagagaacagattcatggttttccggtctcccttttctgtttcccctttggggggtgctggaaggccatctgggagcgttgtatctattaaatgtgggcgttttctaatttggtttgatttggatggctgcatcagcagagaggcttatcagggtatagaaacttttcaatggtatttttattgattatttgggaattttgtagaatgtatcttgatcacactcacttccaattcttccaaagtctaccttcccacccttgtgctccacccccaaaagaagaaaacaatacataccaagtccaatgtgtgtagcccatgtactcattggagcgtggtcaaacttccagtggccaggaccttaaagataactgagttaccctacccctaccaccagtagtcatcaacagtgaggagctatacatcaacatctttaccacaatttataaggactctcaatggttttctgtcttgagtgtttcatttggggaggggggtgttgtcatcgaagccttcagtgatattataaacctaggaaaatctttcgttctttaaaaattctgtcaaatgaggaaatgttgatcattcttcattctaagaaggtccgtgatatttcccctctctctttgtggcaaagacttacaaagaaaagcccagcttcctgatgtagagctgtgtagatctttctagaacctggaaaaagagcaaaacaaaacagcagtggttgtgagtcttttgtaaacagtcaggaatctgtggcttgggctactccctcagaatggtctgtctcttattcttattcgaagatgacacattcttgtttttatcttttacaaaccttcacttgcaaaggtctaggatttttttttttttttttttttttttttaaaaaaacagaaaacctgttaagaaagtgctcgaaagaagtctcagaaatgcagtcagtcatttatcacaaaccagatgattaatttattaggggacagagaacgcattcccaggccaccccaggaaagcacaagagagaaaactgagcaacaaagagaaaagccaccacagcacaataggacaggttgggtcaaaagccacagggatggacaccgagtaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtggggggagaagggctccttgacactgtagggcagtgatgggacttctgcttcctgcctaggtctacgctaacactttgtaagtgtctgcttgctattcctctatagtcgctcagataccatgaggagggtataaggattcaggcattatgttgaccccgccccagggcaactggcaaggtacgggcatacccgcattcaggcagatacttaagcagctcaaggggccctgtgttgtgtgtctatgtcaagtgttatgtggctgcgtaaggactctatgcatgtgcaatcttcccgttttaagcaagcacctcccatctgttcatcccttcttcctctcctcctcccccttcttccacctttgtacccctcccctttcccttccatctctgtaggacagcgtaaggggagggtctaggggtacgcacaggctcaggattggtgtgcctctaggcttggagggcttgccctgtgttgattggtcaactggttgttatggcccataggccctcccagggtggttgctatgctctgtgcgtcattgctgtgtgcaatgtccgtaaagtacatccagggtcgtaaagcatagcgccaccagctaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggtttcagctctcaatgtgatcttcactgccagaaccccagtggctgagtatatgccctttcctggtcttttaattaagaaatcaagcttttactaggcaaatacaaaacaaaactagtccaacaaccaaccaaaccaataaacagcccccccaccctattggtagctctggattgctgcttcctttggttctaaatcaggtgtgtgtgtgtgtgtgtgtgtatgtgtgtgtgttcacacatatatgaaactcactactgtgtcatttcctatgcctgccccatctcaccacctctcagattcttctgaggtttatttttcttacagtgtccaggggttttcattacagtttattgttgttatagttcagtttccccagaatcggaagcctgttatcaatgttttacattaaatcacttcacagttccatcattgccgtgtctgcttactcacgcacatgctcataaaccagattaagtgctggccactctcaacctcagtgcattaagtcccagaaagctcacagactggtgcctggagaaggggccccaggaaggagggggatgccatgcctcctcctttccagactccttgtctctagctctgccacctgctggtgttgaccttagccaggctcctccagccttagctgggatgaagcaggattacacgctgaggcaaatattaaatatttatttgtagacacatagttaagcatgggaatacctaaaagaattttctgggggagaagttctagatttcagggagttgactgtcaacaccaaccactccagccactgttggtgggagggttttggggcttccttgtggagtgatcagtcagcagccaatagagctaaggttttctttatttagacaaacaggtcaagtgcaggccaaagcgagagggagggagctgtaaccagcgcaggtagctggggaagcagaagagaccaggcacccttctgctgaccccttaagaagcctttctacatcagcctaagacttcctcttaccccgccctcacgggcgtgttcaggcacacctgtccgggtacctggggcgggactagagtctcccatatgtttttctcgatgccgctggaaccttctactgtgtcctatcctcctcctttgcaacagcatagcgccatgcatagcagttctctctcagcatgggagctggactggaatcaaatactatacacatacgttctttttcctctccttccgtttggaacagtttctgactatgacttttaaaaaaaaaaccaacaaaatgataacacagtgactgttttatatcattaacgttatttctaggcgctcagcagattgtgagctaaatcacatgcaaaaaaggtagaaatccagtactctgtagtagaaaaaggcattttgtagttgcgtgtaattaaattaaaaagggaagatacagaaaaaccatagaaacataaagactctaccccaaattagaaaactgattatggaaattagaacaggaagtattgttcgttcatcacttacaagcttcaggagtgattaatgaaggcacatttgtgcatttcacacagtaattaaatacttgccgtgctctgaagtgataggatttaaagcttagctaagaaaatttgttttattcaaacttaaacaaatattgctaatttgcctgtccagccatacagcatgacacagtatctttattaagtgccaatgaaatcatgttcaaaattaggtacagacatactgtttgcctgcactatcacctttatgagtcagggatgaaccacctccttcccgcaggttgcagtctggtgtctcaggcatcactggaatggagtgggccttctgtgggatggtgtgggaaaaacatttggcagttggatttgtcttgtggtccttgcaggttagcagttccttcttgggctgtgtaagaagtatttgtttcagaatcttagagtcttcttcacacccagctccatctttcttgaggctactgacagtgcaaacaattcttacctcaaaggggataaaggatagtttattctggaacacagattaaagctaccccaaagcccatgtcccagtgtggtaacagtttcgtgaagtttcatagtagcagaacaaaatataaatcaagatgttttaaaacacattgatggagacatcgggtagatggttaccagaacagcaaggaaatctcttttgggtgtcaggtgctctagtgacaaccctagcttttggattggtgggatctaggtgtttgctaagaacacatccctaagtttttggtcgtcacaggatgaatggctttcaaagcaaataaatagtccaagatgatctggctctggtgtttaacattttagctctccgtcatccccaaatccagccatttggccttttagaatttttaatgcaagcgtgacttccttccccttggaacttcagtccacatgaaaaaacatgcaattccttggaatgacttctcctgggagatttgaacagacatctacttacccaagaggcatccagccttgcttgttgtactagtgagcttaaccagcattacttatgggtgactcaatgtagctatcacaagggaaaaaaaatggccacactgagagctcactctgcccaacctgcaggcagctacagcacgcaagagtatctcaccccctgatactgtttactgctcatgtaacctctgagaggggccttgtgtcatgagcctctatccttccattcaccagggatatcacagtaactgaaacttccatttacaggaggaatccctgccctgctcctagagagggaaaaaggtaatcctcaatgccctgggccgatgagatctggaaaaatcagacaatgacagatcattacactggaaacacatctggaatatttattgtgggaacttaaacaacatgacaagatcacgtgtagaaactcctgcctggtgccagtactgcctaagtgctagtgacctgaaagtaaagaggccaggattcctgtcccccaagagcagtcagtcttctataggaaatacagtgatgattgagatgcagacactttgcctggcattaagatgggagtgacagtaatggtttgtggaggcaacactggggacaggagtatcctgggcatggcagactgaaggtttgatccccaggaaaaggcgagcaagactgtataatttgaggtggctgtaaatgtatagcagcctccctcatcatatgaccaaggaagaaggaatgggaaatgatggagtaaaatgcttgccctggcttgaggaaggcttggagaagtggctctttactctgaaagagcttcacccccacctccctcctgtggcatctgagtgactcaagttgatctttctaataaccagaggcatggatgatatagtccatcagatccagattcaaacaccagtttttcgtttgctgaacggccttgggtaagccactaaacctgtccgaggaagccttcctttcctaaacatgcagcccaaggggcagccattcctgaattcatatgagtcctgaacctggcagtagtaattgttagattgtctaggtggggaaactggccctcctaggaataggttcattccaaaccaaaaaacctctaggtggcaagaactccaagcaggacaagtaagtgaccatcaatcacatcacatactaactggtcctattggtcttccagaggccccatgccagggatgcccttgagacctttcaaacacctgcctcagccagaaatataagaaaacatagtctgttagtttatcttggtgtgagccaaacttggatgatgggggatgcccttctgtatatatgtttctcttattggttgatgagtaaaacactgtttggccaacgaggcaggaagataggcaggactagaagactaggagaattctgggaaaggtaggcagagaaaacctgccagagagtcgtcatgtaggctgccaaaggagaaataggtccggacccttctctggtaagataagaccacgtggaaatacttagattgatagaaatgggttaataattaagacagagatagccaataggccttagtcatcggccaacagatttataactaatatagagtctgtgtgtttatttggggccaacggctgcaggaagctccagcaatacttggatccattaccttatggtgtaacacctctccctccttactccctttacaggggaccttaaaagaaaggctctactctccctcagcaggcctgaagcatcttactttagacccctgatgccatgtgctgtgtgctgtgctgcccatttccagggcagcgttaatcaagctgttgcctgatgatttgactgtctcttgaaacctcccttctcctacagaaccctaaaacctaacaacagtaatgacagcaggagcaaccttccaagcagacgtactgacagtctgtagaatgtgagctgtgtgctgtggctcgcacaggtttggatttgatggcttagaaatatggggatgctgagttcaatatcacagatttctttctgtgcagagacgagctctgatgtgtgagaaggtcagagatactggaatgcctgcgtggcactccctatctgtgtcccctgggaaagcaactgcccctgtgttttgtaagtcccctagtttgatgtgctccaggcaggcagaggagaacatagttttcagctctttgtctagtcctaccctgccaagtcctttcaggacagactcctccaggggcagtagcagaactgctttagggctcctggagtttctctaggcaggactgcatggccctatgaccctatggcccaatcttgctccatttgcatatttccacccctgaacacatcccattttatagttatggagcacagcctctccctgctgtgattcttatgaacaacttgtatgtcttcgcagcaacagtcctgtgccaatcaatgttcttgtgtgttgtgcatgttcagcttattgaagaattcagggagagttttggagtcacagtaagtcactgagcaacactcttatctaaagcaaaatgaagaggcctcaaactttggggtgtcgtgatatttatccacacggcattcaccaacaatatttggtggcccagaagaagtaggaggctgggctgtttctgagctatgcactggtcaggtaggagacagagaagaccaatcaagaggagccttttttgtggtgtgactacgattggtgactgggcccctcccacatggctctagacaaaactttctatttgcatctgtgtaaatgtatatgataatagatggtaaaacctggaactgattaaaataataaagggagttactgtggtaagtttcaagatggattggtacagagagtaaataaattagtcaacatgtataaaatagtgttgagtacataggaagcattcaacataggatctggtatctcaacatggttagtacagtcccaaatttgcaccttcctatctgttaccagtttttcctggtctgtctccataggaaaggccataccctatcatttctgttacagaagagtgagcaatcttctttcccaaatatgtcacaactcattagtatgatatgggttacatttttgttccactgtctatggccaaaccaatgtcatttgctcattagcgttgattgtttcaactgagacaattatcatggcaagagagatgaatttcacagaggttgtcgagaggaacagaactagacactcttcttgggtccttcatgagggtcagacaatgacagtttgctttggttcactgagatagtagaagttcttcagtgcactgtgtgtgatggttctggtcatcctctgttcttcctacactggtgaaatctgccctgtgtagttcctgtctcctctgataactgttgtactttgtactcacttgtttgtctgtctgcctttctttttatttttctttttgttggttttgagacatcatctcatgtagcccaggctggcccctgacttgctctgtagctgaggatgagcttcagcttctgatcctcctgccgtcgcctctcaagtgctggggtcatctgtgtgcaccattggacggcacagctgtcttcccaagtgatgggtatgtgatgtcgttcgtctctttcccatcatccggtgactcttggttgcttcaaaatgaacacccaaatctcagatatgacccacaagaccctatcaggcctggatnnnnnnnnnnnnnnnnnnnnnnnnnnnnnnnnnnnnnnnnnnnnnnnnnnnnnnnnnnnnnnnnnnnnnnngccctatgtgagggagagggcctcctcccaccctcctcttttctcttcttacaccttcccttttacaggtttgtttctacctagtcttacagtctcagcttagctgttctttctcctggatgtcttccctggttgggaatctgcaaagatatgagaatccatggatactcttattttttttaagatttatttatttattatgtattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatttccttccctggaagacagttttgcaaaaattggtcatgatggcctgtggctcaaaaggctatggttgaatttttttctaagaagctcttatttgcatacattctgcaacgagtgtcttatggctttactggggaatgtcattttaagctgagagaagacagaggagatgttggttaatttgcatttagcaactatagatgccgttatctagtgaaggaacagaacgaactaggtttgtctgagaacaacaggctggatggtttcttctcattctgtgtttcctcttggtgcaaatgaaaaaataagaagtccttaaagccaacttcacagtaaggacgaaacacgagcagaagtcactggcgcttaattgtcgaagggagctggctctggtactactttcagcttttccctgcctgagttacaaaaataaaccttgttttatcaactgtgcttctggaaagaagtgtgtctcttgagaaatgaggaaaaaaattaagctctaaatatactacgcagtgattttgaaatattttatcttcttatgccagactgaaaacacgttctgtttgaaaatacagttttcttatgaagaagacctcatgatgcaaacattcaaatggtcttggttattttgaaataaattgttactttttgtatgcagtttggagaaaagctgactggcacaattattcaccaatttagtggctgtttacgcaggtcactgcagggtggcctttgctttgaccattgctggtgtttgtagacgttcctgaaggagataccatcttctccttgcccgtctactctctgagagtctgtaaagttctccatcctcgcagtagggaggaaaataattggggagctataggccaaggtgatagcaccaatagtcagttctcagtgtctatggccactgcaagaattattgattacaaagacagtttgtcgtcagacttctactggttcatagtgatagccaacctgcctttttacaattcgtattttcaattagtgcatattaactacatcttcacagccacacaaactcttcagctttttattttctcagttattgaagaccaacagcccttctccttttagcaaagcatgttttatttctatgctgtgagcaaactctctggatgtgctgcttctaacgttatagatttaatttagagcctgagttggaggaaaaggtcagaatccttttcttaaagctccagcacgtgcacacagcaaggccggatctcctttcatcggggacagtcttccctgttacagattgtggttatatattttagcaaatgcagggtcaaggcttcgtagccagccagtttgatgacagtttctctctgttgcctgggaaactgtccctcaaaagcaaaggcataaaataataatcaccacctctttggtcaaaattatgccacagggcagagctctcctagtcagcttgtctctgccctgaggtgttagctggactcatttgtatgcctataccattcaagacggatgcacttctaagtggggatgtggttcggttggtacatccctagcactcaagaagctttgggcttggtccccagcacagcataaactaggcatggtgatgcatgcctgcgatcccagcactccagaggtagacttaggaggttcagaagttcaaggtcatccttggctacactgagtgtttgaggccagcctgggatatataagaccctgtctttaaaaaacaaacaaacaaacaaacaaacaaacaaacaaacaaaaaacaacgaaaacaaacaaacaaaaaacaacgaagtagaagtgatctggagaatataaactcttaagacgataaacaattacaaagcaccacttttttctttgttaagagtttgcattattttggcctcatattctcttgcatgtcaaaacaagtttcattggcatttggttatgtgcacagtcttcagattgctaaagtggagtcagcggtagcagtaactctgtgagaaacagctatgtggtgttgcttagtcacagtggcacttgtaagctgtcttagctgctacaatcaggatctgtccttcttcaggagtctgctcaacacattcctgataatttttgtccactgtctgcttgcccccacctctgtcgtctacaccattgattttccagggcagtttcagcattcctgggcctcaggttcagtttccattctccctttacagccatgcacaggccatatcccttcccgtgtcagctcagagctattcctggctcatccctgccctcctcagctctgcccagggatcctcactgctcctgaaacacagtgacaggcatagccctgcctctgcgcttctgtcatgctgttcccaaggttgttcctcactttactctggcctttgtaatgtcacagatacagatttctccagcaagaaatcctgtttcctgtctgtgttgcaggccccattttgctacttccagaatctattctgtggatttttggttgaagttaaaaataacaactgaatctctgttatattttatagcatataattattgtacaaaatgatatggttagtatattgttgctggaggttcttgtctgccaggtcctgccacccttctcagccccaaataagcacacagatgttatattaactattaaactgttggccaatagctagggcttcttattggctagctctgtcttaattattaacccattactactaatctttgtatttctacgtggccttatcttaccggagaacacccggtgcgtccaatcctcccgatccctccctggcctctctctggtggtctctccctgcctacctttcccagaattctcctcatctcctagcctcgcctatatccctgcctctattggccaaacagtttttactgatcaaccaataagagaaacatatatacagaaggacatcccccatcatctcctcttttctgtctaaataaaatgagggtttttaactttaacataataaaactgcgtataacaaacaattatcaagtaagaactataattaacaatatttagtccactaacatttggcaaaatttaaagaaaatattctatcatctatcccatctttgtgagtctaaagtcttaaatgtaacttatcttttatcataactaaggaaaaccatagacataactattcgtcttcaactccatcaaagaccacagaaggatgccacatataagaggaaacttatgatacttgtctttctgggtctgaattacttcatttttccaaaatactcaggaaactaaattctacaaatttctaaacaccctcctccagccccaacagctttctatgttgctatacttttcagggctatagtaatgatataatatggcaagaaacaaattttctacttacaaatgaaatcttggacccctggtttcctgaaaattgaatttatgtgacttatgtctttgagaattggtttctaacagtagaataaattagccaaaaaagaagcaattattccaggggaagagttaattaatgctgtacacttgccatctccttagttgactgttgtcctctaaaacttaattgtgttgtcatttttgaaactcaaagatttcctcaagatatttgctccctggtattttatgtatatcacttcttttttaaaaaaacaatcacttagatttattttattttgtgtgtgtgtgtgtgtgtgtgtgtgtgtgtgttttccctatatgtatgtatgctcaccatacgtgtgcctcgtccccagggaggtcaaaagaaggcacagatatcctgggactggagactccagccctcaacatcacttcttaataacatgattaacatagtaattatgtaaatcaaaattttattggcatatagtcactgtacataggcctgggtacaagtatcatggggacattttcgcacaaggatgtaacatcctttgtgtatgtcctgcccccattgctccatgcctgtaactctcttttgatccctttgacagtttagaatctgttttcatgcttcatttgtatttataattttatataatcatataaaatctgggattcacaagtgagaaaaaaacgtgaactattttctgagtctgacttaacttacttactatgatgccctcctgttgaatccattgaccatactctctttatccattcctccgccgatagatgcttaggtcattagttgtcgtgaacagtgcagcaatacaatatctcccatatgtttagactcttttaggagaataacaggtggtataactggggctgttcattttttaaggaacctagtgtggatttctgccaaggctgtattagtttacatacccaccaatgatgtctaaggactcccttctggtcacatcctcaccaccatttgctgttatttttttcaaatttcagtgcagttttttccttttttaaaatttgaattagaaacaagattgttttacatgtcaatcccagttccaactccctcccctcctccactatcacaccctccctaactaaaatcctacctatcacatatcctttctgctccccctggatggtgaggccttccatagggtgtcataagagtctatcatatcctttgggataggtcctaggcccacccccgtgtgtcttgcttcagggagtattcctccatgtggattgggctcccaaagtccacaactatgctagggataagtactgagctactacaggaggtcctgtagatttccgaggtttcctcaataaaatccatgttcctggggtctggatcagtcacatgctggtgtcccagctatcagtctggggaccaagagctccctgatgttcaggtcagctgtttctgtgggtttcaccatcctggtctggacccctttgcccatcactcatccttctctgcatctggattccagttcagttcagtgattagttgtgggtgtctgcttctacttccaccagctgctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttctgctgagtagtactccattgtgtaaatgtaccacattttctctatccattcttcggtagaggggcatctaggctgcttccagtttctggcgattacagatagtgttcagtgcagttttaacctgcatttctctgatagttgatgatgctaaacacatttcatgtgtctattggacatctgtactttgtcttattgatataattttcatttttaaggcagttttaattatgtgtatgttgtgtctatgtgggactatgtaaacatgagtataggtgtcctcagagaccaaaggtgttggactcttagagctggagttgcaggccattgtgatctactctacatggattctggaactggaactcaggactgtaagggctcttaagttgctgaactgtctctccagccttgatacatttttttattattttattttatttttttggtgtttcacgacagggtttctctgtgtagctttggagcctatcttggcattcgctctgtagaccaggctggcctcgaactcacagagatccacctgcctctgtctcccgcgtgctgggattaaaggcatgtgccaccaacgcccggctgatacattttttaaatgattgatttctttcagccatgatttcctaacctgtaaggtagaagcagtagtcatcttactttaaagactaatgaagatggtatgatctaaggagtgggaaaaactttaaaaactataaaatataacacatgctagaaattctagtggcacagcttatttaaacttatttactttgtgtctcatttttccttcagacacacactttctctcaaagatagtgtcctagttacaatgatcaatgtggagtggagtaactacattttcacccactggaaatgatggtagatataagccatgagccccttaaatgatcaaatagctgtgtttattaagaatttacattttcaatgtttaactgagaagactaaaatccccagggattagacattgttttcttgattgctaatttattctattcctgatcaacatagtaacacctatgtctttgtttttcaaatgaaaatatgctgtctttatgggaacttctaaggtcatcgaatgcagtatcttataatgtgtgaatttttttaaaaattcaatttacaaaaaaaccccagcaatcacaagaggcatgaagagatagagactgaacaggactgtgagaagggaaactggagagccattcagatggtcgtcaagtagattcactatcaccatagagctttgctaccctgggaatctgagtttattgttttcagaggaaatagagattaatcactaacaggattttgtatgacatacctgtagaagtcaaaatcaaaatgagcttaaattagttctgacagacagctcttgaattattcatcatttcaatagaaaatacacccccactccctaccccttaacccccccccccctaaaattacagttgttcaaatatatgtgtaaaagacaaatatacagagtatgtattgcttctccatgcatatagagtacatcttcaaagtgcatagtttaagagaacatagtttacagcaaaatcaaaataaaaagtgattaaaaaaaaaacaaaacacctgattgttgaagaatcccttaaggaagtgcaatgctagcattaattggttgaaccctaaggacttttcacctaattagggagagtggatattgcttccaggcacttcacatttccagaaacaaaacaaaacaaaaaaagaccttcattgtcgatggggaggctgcatgtgtgtgcccaatcagtgcatttctgtagacactggccaccctgctccatgagacgtaagggcgctgtcaaggccaggcctcactctggctgagggcctctccagatctctccctgaagttttgggactcagcagctgtgtgcactgctctctgctcacaggggtcatggcttcttatgtgatgaaggatagaaaggcccagggtacacatctcatgaaggagatggcctgtgtgggagccacttcactgtcctcactggacacccctcagatcggagagttgtcaggaagccgagcttagcataagcaaagtgtaaataaatgactcaaacttggaatttcagcctcgctataacaaactcttagagcaggaaccagagcacggcttcagtgggtggccgtgtctgtgacttccactgactgtctctctgagatggcatctggagtttactggcccttgactgctgcctactgtgtggtagaggggtatggagtccctggagttagctgtcttgactatggaaggttcccagagtgaagcagaggatcttattgaggctcaggatgatttctgtcaggctgctgtgtccctaagctcttatgtggcttgtgagctaatgcagcttgcgttttcaatagaaattccgtctgtcctcagaaggaattaaactgatggggcagaatggagtaggagtggggggagaatgacatttaatcaccctgcaacttgacaagcgctgatcctgtttttattacttgggagttatcgtggcttttctacattaaaagccatccccattgtcttatttttagaacattgggtgacagagatggaaagtgcctattaaatagcaaacatgcctaacccaaaggaagcagacacagctaagctagacggtggccgtccagtggcatcttttagcttttcagtgagaatgtaacattaattctccaccccctcggttgtgtatctgtggaagtccaggctattggatctcctctgcatctgcttctgtcactgagaagggctgtgcatttggaggtttccttgtatcgtggcaaaatgcttaagtgttctgccagggttttagtcctaaaatataagcctggaagggctgggaaaatggctccataaataaagtgcttgctatagatgcatgaagacctgggtttagatcctcagcgctcacccaagaagcagggcattgagtgaggagccagcttgtaattcaagcactggagagatggagccaggatgatcccagaccctggccagccagtttggctgaatccatgagctgtaggttcagaggagagagactggggaagatgccttacgttgtcctctggcctcgaccacacacatgttcacacacaaatccacacaatgaagtcaggcaggagaaacctagaataagaataatgtttcagaaatcttgcatttttactttctctttaaggcagtctttcccctgataggacactgtgcaatgaggaggccagcagcccagcaggtctgagccaaaagggacattcttctgtaaggaatcgcagtgtgtgtactgttgtcacctttgcctggtagtgtgttttaccaggtggttatttattttcatgctctgtggagattattttctgactgaggcaaaatccaccagtgttttattttgagagtggaatatcatggagagatggaagagcaggccaccctgtgcctagcttggggttctatgtacaacaaatggtgtagtatctctcttctttccgccattcaagcactctgtgctgtgattccagcaggggcagggtggggtgtacctagagtattgttcagttagatcacagctctgctggtccaggcagaatcctggaaatgcctttaagagtgtggagtgtgaagggctttgcaatcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaacagtatctctccaaatgtctttctgaagatgctattccatagctgttcctaattgaccaaaacaggtgtgtggggcatttgccgctcagataggcttggaaaatgatgggtttagcacagacacagactctctctccctctcccaccctcattcttttcttatacattacatcctgactacagttttccctccctggactccactcagtcttccctccccaacctcccctctctcctgggcccacttctgctccaatttccttcaaaaaaaaaaaaaaaaaaaaaaaaaaaaaaaaaaaaaaaaaaaagaaaaaaaagaacaggcctcccatggatatcaactgaacatagcataacaagctataacaagaccaataagactaggcacaaatccttatatcaaggttggacaacgaaacccagtaggaggaaaaatgtcctaagcacaggcaagagtcagaagcactcccattcccattgttaggcatcccaaaagaacaccaagcctctcaaccagaacatatattcagaggacctagctcagacccatacagggcctgtgattgttgcttcagtttccattaacttctaagagccatgcttggttgattctgtgggctgtgttctcatggtgttcttgacctccctctggctcctacaatccttcctttccttgttctgcaaggtttccctggcactgcctagtgtttggctatgagtctcagcatctgttcccatcagtttctgggtgatacttctctgatgacaactgggctaggcactgatctatgagtatagcaaactatcactagtaatcattgaacttttttccaattgtctttggttctgttctgtatctctgggctgtccagcctctggttcctagtcatccaggtagtgccagtatctctctctcatggcatgggcctccagttggaccagtcattggttggccactcccacaagctctgagccaccattgccctagcacatttttcaggcaggacagattgtaggttgaaggttttgtagctgggttagtatcccagtccttccactggaagtcttgcctggttatagaaaacagccagttcaggctctgtaacctccattattaggagtctccactagggtcactcttgtagattacagggagtttctattgcacttacgtttccacactgccatgcaaatgcccaccaattctcttccagtactctctccctctacccatcccccaccctgtctgatcccttttattcccatccacacccacccccagtccacctacaaatctattgtactcttcttcccaggaagatccatgtgtccactcttaacccccccttgttacttagcctctctgggtcaatgaattgtagcctggttatcctttacttaacagctaatgtctacttataagtgcatacagactatgcttgactttttgggtttgggttaccttactcagaatgatttttttctggttccatctatttgcctataaacttcacgatgtcattgtttttaacagctgagtaacactgcattatgtaaatgtaacacattttctttatccattcttcagttgagggtagcacagatagacattttactgtagtgtcctctcaaaagtattattttttttagcatatgtatgtgtgtgctgtgcatgtatatgtactcatatgtgtgtgtgtgtgctcatggatataaaggcccaaggttaacatctgatatcttcatggattgcctctctacctcatgtactgaggcaaggtctctcattgaatctagagctcattggtttggctagcttgactaactgattgactgactgagcttgctctggaggtctcctgtctcttccacctcctatgttctaggattgcagcatcctttcatatccgaatgtgctctgtgaatctttaagaagaaaatatgaattcagcattgaccaaggaatgacttttcttagggaaacatttcttaagaccaacattccaaagcatataatctggggatgaacacacagggtatagaacttggttataatgcccagtttgtcctcctggtaagaaacagtacactggtgttagaattggtaatggacattcttaggagtggcatgtgctatttgtttgttgccatgctaggcccgatcgtgtaattggactgttgaagatgggatttggagtttgggatcttgtgtatttattcacacaatgatgatttcagaagtgataatactcagaatgaaggctacagtcacaaagcaaacactgaaaaagttaggaatcaagagcagttaggaaactgttatctatgtcttttaaggagacgagtatttattcaagtagagaaatggagaaataggaccaggaatattttcatccagttttgtgtctcttcttgtgcttatctgggccacatgtttgctagaaaatgaaagaccacccttcactgaattatcacaacacattgcatctcctgctgttgctgtgccatgcttatcaacaaaggtgaaaattagcaataaaattttacctagcagtatttgtgtttagaactttggaaaccagaaaactcccacaagattttctcttaaagttagttatttgattaattttaaggtggcaatgagacttgtttttactttcagctcaatgctttggggctattagagtaagtgaggattcggaaacttttggttattcatattattagcacagatggtcttacctggggccttttctatgaagtcacagccaccaagctgaacatgcatagacaatgattgacaagactgctagttttcattgatgcattgacaaagactttttttctgggtcatccttaaaattagtgggttgtttttgtgatggttaattttgtcaacttgaaatgatctataatcacccaggagacaagactctagtattcccacagggactatccaggttagattaactgaggtgggaaaatctaccctaagtgtgagtagcaccatccaacagcccaaagtcctggactaagaagaggaaaggaagcagaacacaggtatccttctctgtgttacgactgcacacatgtgaccagcagtctcctgatccagtcaccataccttccccgccatgatgaaaggtattgctgaaatagcaagtcaaaattagtccccagggatgtggcttttgtcaggtatgttatcacaggtacaagacaaggagaaaatatgagtttgctctcctactctccacaatagagctgatggatcatatagtataatgggccctcgttgtttcctgattacactgcacccaggactatattcactgattatgtggatggatgtctgtatgtgtgcttgtgatttcttcagtctcattaagcagaatattggttaactatggagccacttttgtatagttagtacttataatggtgtgaagtaaactttacactaaaaaatagcctcagctctcatgatagaacataatatgaagaggttgaaatcatacacacacacacacacacacacacacacacacacacacnnnnnnnnnnatattaccctactgttgagggtatattgagtatagatcactttctttttttaaagaaaaaaagttaaaagtaaaatctggatactgggtactttgagatagaaactaaggaggaaggtaacttctgaagcagaaattccatctcactaccaggaagatccccatgaaaacaaagggagtcaaagatacaggaaactggagaatagttattgtggtctttatttagattacaggactccagagtgtctggtattttattctattgctattggttttatggtttcgccttccttctagggactcatttgttaaagttactgctgcttctcagcagtctacttgcagccttaaagacagaaaggttggaaaaatgggttctgatgcttttgggggatggaccaaatcaaaacctgatttcgactcccagggagacctgtggaagtttttcctctgcttcttcccaggaaagttagttctcagggcttggctatgcagacaactcattctcaggaaagaggtctcaacacttcaatgcaacacgcattgggtcagcagaaactcttctaaaccatttttactaaaatccaagaaaggtatctgtactaccatcttctttttttcaagtcacaagtttctaataaccttcttattattgtatttgaatctaacttcaagatgtggtgtgtgtgtggtgtatgtgtatgtgtttgtggtgtgtgtggtgtgtgtgtggtggtggtggtggtgtgtgtgtgtgtgtgtgtgtgtgtgtgtgtgtgtgtatgtggtattgtggtgtgtgtggtatgtgtgtgtggtgtatgtggtatatgtgtgtggtgtgtgtggtgtatgtggtatatgtgtgtggtgtgtttgtggtatgtgtgtggtgtgtgtgtggtatgtgtgtggtgtgtgtgtggtatgtgtgtggtgtgtgtgtggtgtgtgtgcggtgtgtgtgcggtgtgtggtgtgtgtgtgtgtgtgtggtgtgtggtgtgtgtgtggtgttatatgtgtatgtagtgtatgtgtatggtatgtgtgtatggtgtgtttgagtgaactgtatgtgtgtcgtgtgtgtgtagtgtaagtttctagtgtatgtatgtggtgtgtttgtttggtggtgatgtgtgtggtgtgtgcggtgtgtgcggtgtgtgtttggtgtgtgtgtggtgtgtgtggtgtgtgcggtgtgtgcagtgtgtgtggtgtgtgtgtagtgtgtgtggtgtgtgtggtgtgtgtggtgtatgtgtgtgtgtgtgtggtgtgcgtgtgtgtgcgtgtgtgtgtgtgtgtgtgtgtgtgtgtatgtggtgtatgtggtgtatgtggtgtatgtgtgtgtagtgtgtgtggtgtatgtgtgtgtgtgtgtggtgtgtgcggtgtgtgtggtgtgcgtgtgtgtgtgtgtgtgtgtgtgtgtgtgtgggttttttgggtgttgtatatgtgtgtgtgggtgtggtgtgtgcggtgtgtgtggtgtgtgtggtgtatgtgtgtgtgggtgtggtgtttgtggtgtgtgtggtgtgtgtgtggtgtgtgtgtggtgtgtgtgnnnnnnnnnnnnnnnnnnnnnnnnnnnnnntgggtgtgtgtgtgtgtgtgtgtgtggagtatgtgtgcgcacgtgtgtgaaggtgaaaaggcaataaaaaaaagtcaagtaaaaccagggattcttttccctgatgctgcagcactgaagtgtctggaaggttcttttgtaaaagctatgccttccacaacactattcaggtgggtttcaaatgaggcaaaagctggggctatagcttagtggtacagtgtttgcctggcatgaacaaagctctgggttcaatccctggtgttgtaataaacacataaataaacaaaatgcaggtgtggtctttattttatgagcacctcaaggtccaggaagtggatcagagtaaagagaagctcatttctgagggcctagattctcatcctggtctgcagttgcattgctgtttgttgtttttgcatttgcaagcaggatgactgaatctcagtgtagacaattcagaatagtagattatggaaatcgtaacagttaatacaggtatggaagtctgttttccagacggtctttgtgccctccaccttacttgatttcagagtgatgattgtcagggcagctattgtcacctcggctttccttcccagactctgacaaagctggatgacctcatgtggtccaaggttgaatcccagctcggagatcctcatcctggtcagtttcctttacttcccacagtgcttgccaccccaaatttgtttaggtttccattttaccatttcatttcctctttggaggaatgcttcctcctcactgtgtctcaagaaaaatattgaattttgtttgcattcccctgagttagcatctctgatccagaagaggtgacccagaaagcagcagaactaatccacatttagatagctttgggttttatttctactttccataagctatttatacttctccaagtccagcctcaaagaccaaaatttcaaattgatttttttttttttttacttgatttgtttttctcctgttttgtctctctgcctcacagtagaattcggcttttgtttcagtgtttgctttacaaatatggaccttaaaaagcaagaatttaatcttcatgtttcttctaaaaactagtctcagctcttttggaagatcaaactgaattagatttgagcagcccttacaaagtggggcaatgtcaatatcgttattttctaaggaaagtcgaatcctggaaaagacctcaacatagtgcccagatcacctcatcccgagctctgcttcagccttcactcccccgggggtcacctcaaagcagggagtccagggagtctctcccgagtcttcaatggatgctgttagccaaaaaaagcatgcagggttgatcagtctagaatatgaagacagacttggtggctaaattgtgtagtacatgaattatatctcaataaagttaattttttagaaataaaagagaaaataaaaacagaagccattagaaattttggggagacaggcaagcttcttagtttccctaggagctaattaaatatatcgacatctttaaaaacattcaggaagttccagacaaatatcattcaatttcttaataatatagatgaccctatttactgtgaaaacataggtcaccctgagatagcagccaataacattgaaatttcctgatgtgtttaactttgtaatgaataattaagcagcaaagccagaacactgattattttgtattatattgatatatctagacattcctttatacttgttcaaagaaatacattaagagctggtgagatggctctgtctgtaaagtgcttatgctgcaagccttgaagaacaagttagatctgcttgatcccatgtggaaacaacaacagctgggtgtggcagtgtgcgcctgtaatcccagccctggggaggtggagacagaatgacctctgcctttcattggtcagccagcctagccaaatcagaaagttcaacgattagccctgtctcaaaataaggtggagagtgattgaagaagacacccaacagtgacctttggcctctacatatacatatgtgtgtgaaccacccccacccacatgcatgtatacacatgaacacataaaaagcgatgattgaaataaaaatggttgaataagcttgaaaatgtcgtaccacttcagggcctactatcccgaattagccacaggctcacattgacgcaaagtgaaggacagagttctctgactccctgatgctgtcccattgtcactggatggaatcaaggtctttcggaatggcacagatctccatcaatgtgagcagcctgaggctgtgtgccccgttccatggttctggattctttcctttgcaatgggagttttagagctgtggctcccacaaaggtgcagtttccagtgagcaattctgatggtgtatcttggtgagtgaaaaacatgcagggttatgtaaagttaccatccctgtttgggtgacatgggctccaacagagatgctatataggaggtcaatcttgtgataaaaaacaagccatttaaacagtcagaccttttttttattttacttatttggacttttgtttgtttgtttgttttgaaacagggtttctctgtggttttggagcctgtcctggaactagctcttgtagaccaggctgatcttgaactcacagagatccgcctgcctctgcctcccgagtgctgggattaaaggcgtgtggcactaacacccggccttatttagacttttttactattatcatgtgtgtgggtatacatgtgcctcagcatgcagatggaggtcagagggcaactttgtggagtcagtttgctgggaaccaacatacaagttggtttccaggattgaactcgggttggcaggcttatgtggtgagggcctttgtccaccgagccatctcatcaacgcccatcagtcaacacttcagttaacatttcttttactcttctgactttggaaagcatacaggttaaggggtctgcttcctaaattcacttttgcttgaaagagatttccagggaagatgttggtgaagagttttaaaagcctttaactgaagtagcaccatcagccataaaacccaagaaaaaattgccagtagttagatagcagcaacaaaaaacttcatttaaaaatgtgtgccggaggaagtcactctggggagtgctgtgatctgagagtggattgtgtgtcatcctgaaagactcacagcgtctatatgtatgctaaatgagtgtgaagtgagtgagtggcttcttgggaaggcagcccggaggtacaacttgatgacaagctggcagccagagcaagcaaagggctgactctcagaggggcagagcagagggacggcctcctccttgggaaagctccaagactacaagtcacatgtgcctgacacatgtgaatagacagtgagtgtgctgtcatttgtaacgccagcacttgggagggaaactgaggcacagggatgggtttgggagggaaactgaggcacagggatgggtttttggagggaggctgaggcacaggcatgggtttgggtgggaggctgaggtacaattcaaggccggtatgggcaatatagctagacttctctgtaaaacaaaacaaatggggaaaaaggcaaggctaagaatttgctaaactgaaaaattaaaaggtggtagaagggcagtaaaacacatttttgaggtctgtcgtagcaaactgccacggaggcaaaaatggcctgggaatgagcagccttgggcatacgatcatgaaaatgcataatgtcaaaatgagggatttccctaccccagggagcctccaggtgggctgcaggtgctgtttcagctgcttttgctgtttcccacagcagctctgttgaagccaggagtctgacagtgagcctgggtgtggcccgagcccaggtggtgttgggatggcaataaggttccagggcaagaggtggattgaaggacaggcaggtacaagagtatttgtgagttgtactcagtcgcctgtgagagcccattaccccactatactgagctgagctcactctgcatcctgggagaaaagcgggtgataacaacactatgctaatatgcacctgaaaacagcctgtgggagttccccagtggcttaacacagaggtcagaggcatgcttcatacctagtcaacaagcagtttggagagcctctacacccctcttcgtctgtatccaaggactgtgtagaccactaaggggctggagcaacattgctaactcaggcacagcagtagttaggcttctgtgttatggccacagacataatggtcaggtggtggcctgatgggtcccgtggtatcagtgacagaatctttactgacaaagggtcccagggcccctccaagccagctgtgaagagcaaccagcccttccaataagaccacagtgttagaatagccagctttctttgctactaaagttgcatgtgccccacagcttgatacattgtgtttgaaatttgttcatattgaatagagagccaagcctggccctggtaggccctcctcctccgtgcacactctgcagtgggatgacccagtcccagggtccctgtcatcctccagaactttgtggaacagctctggagatgttggtatcgccctagaaaatgttctgctaaaggtgggggtaaggtattgtgagcagttgtatcctgctgagcaaaattccccagtagcttgtcaggagaactggagtacctgagcaactccaagccttagcatcctttctgctgagggtccagaggcaggaaatctttcggtaccttgacaaagtctcgtttagttggctctgagtgaaaaattcacagtaaatcatgcagtcactgcaaaaactaataatattgaggtccaccaataagcttttaggcaaagcgtcattaactctctaagtctcaggagaggttaagaagaggttttactccatgaaacacaaccccaagttcataggctggagtttaagtcatctgtcaagcaggtcctcatttccacttaatcttatgcaacactcttaaattaaattaaattaaaactaccaattttaccaaatacaatttacaaaatatataaattaagatagtcagtttgtaatgtatgagtttagaaacagatttttcaggtaacagctttgatgtgtaatttcaagattgacactgatctctatgacggttttcttttgtgaaaaagaaaagcctgggctctgacacaaatacttaccattctatagcagggaggttttaggttagggtcatccactcaggtgaggcattctctatcaccttctgttgagtatgattttaaaaatagatggggaaagagagataattattgcccactcattgctattacttaaaatgtatgatttttctagagaagataattagtgtatcttataacttctctattttttggccatagacaactaacctgtagtataagatcatttactgtacacgaggtagatgaatgccgtgggcatctgtgaaaaatgtttcaccgctgtgccttatggtgccaccatctgcccaagaaacagtgtttgctaagaagtgaaactacagtctttctgctgttatgtgaaacatttgttttactttaggggttttgttgtagttttccatgcctgcctttctccttcattggtgtccactcaaacattgttctgtttgaaagagatgccatgagggctgtctctggtataacagtgctggtcctgtcatgctgtcttttaattcccctgatgtggactctcccgtggtgtaaagtttgtttgtccattgtgtcccagcatcccctcagtatggtctcctgtattccatcttagtgactacacaccacatagtagatacttttgatggtcgatcttgtcagctttctgggatttagagttacctaagagacctgcttctgggtgtatctaggaggatattttcagcaaggtttaatggaagtagaaaatcccagagtagatgtaggcagcattatttcatagtctgaataaaaaagagaaagtgaaaagagcacagttcattgtaaaaggagtccttaattggtctagataataaaaagctggagtcagatatagagagaaggaataaaccactgctacaccttgcctccttagtgtctcagcagacaagggagtgatttactatttctccctgcttatatcctgagcccagctacatcacttcctgtctgtctgtacagaccaccagatctctatggttagttaatggcacactctatcctctgacccccagacaggctttatttgtacaagcaaggtattaccacagtccatctcttctgtttcttgactatagatcagtcactggtctacaaagtgaccaactggcccacacctggccacactgggcatactctcaaattgtggaccaaaataaccgtttcctaagttgtttttgccagggattttgtcacgatgagaaaagtaccctagtacagtgctcagttaaacttacaggatgagtgactatagatttttaaaaaatgtatttcatccatttccactttattcttgcattaaggctactgcctcatcagagttctggggcaggaaggggaaagagctcaggcattcacagcactgattttagcaaggtgttctctgtgcgacactcttgcctacacagaggaacgttataggaaagagccgtgtgaatcactcactgtggcttcaggtttggagaagggtcaaggccaccagcaggcacttcactagggaacattttcatatacataccagggcaaaatttctcccttggcttacacatctgatcagttaaatatctttggttgttgtatgtgtatcctggtgaatagctcatacgctgtgttttactgttggctggccttgcatttactcctgacttgtttccctctcagtggttgacttcatgtaacttaataagcatgtagttgctttcactgtaaatgaaaattatagcctccacgcatctgggtgaacacattgcagatgtgagcgccatttccagatgctcctccatttatttcttccgtgtaataccctctctgctgtgcctttcttctaaactctagggttcccccagatataaaccagtgtcccccttcccccaagacctgtctcccacttctgtctttgcccatcagtcatgtattttcacttcctgtttcaagatgactgagctgtgatttaaatttcattaatttttcagcttggcaggcttatctcctgagcaaaactgcccacttctacaagagaaacacaatgcctttggatttttccatagctccccagaaaagtctagaattatgactgcatggaaacctatgtgagtgagaagcaccgggaaaaactggggtctcctgagaaatatggtgatatattatttatgatttattaaagcttgactggggattcagaaagcagtcatctacaagacgtagaagccagacactcacctttaatcccagcagcaagaagctaggaggtggtggtacacacctttaatcctagtactcaggattaagaggtagatggatctctgtgagtccaaggccacccagatctacacaacagtgatccagtcctaaagagtaatagctcacacacagatgatcttagcacctgggatcatacacctttaatccaagaataaggaaggtatataaaataggagcaagatgtcagtatcaggcattcattctccagccaccttgagaataggaacaccccagccttttagaggtaagagctctctgggtagcttggctgctttgcttccctgattttcagcttgaaccccaatatctgtctctggttcttttatttatcttgttacaaagaaaaggtgtgaacggctagaccagacttcatgtaggtcactgtatcagtccaatttctcctgattttgtcagtcctctcagtggttcacagagcaaggggaggtgaacaatagttctgggttctaagttcagccccaggaactaggtatgtgagctttagaaagatgctgatctctcaggatccctttacaaatctaaagaggtgtgtgtgtgtgtgtgtgtgtgtgtgtgtgtgtgtgtgtgtgtgtgtttatgtgtctgtatgtagggggtcagggagctggctgtggtggcaaacacctttcacctcagcacttgggagacagaggcaggcaaatcactgtgagtatgaggccaacctgatctacataatgaattccagaagagccaaggctatatattgagaccctgcctcaaaaacaaaataaaataagtaaacaacattatctctactcttctaattataaaattttatgagttccttatgttatcccttttgtaacaactcaactgtaaccaacgttataatggatagaacagattccagctatgattaatgctatcatctcaatgctataatatattcatatttaaaacagcaatcgtgctttcaataacacccaatttcccaatttatttatttatttatttatttatttatttatttatttatatagactcctctatctcaggctcctggaactctgtagctcagaatggcctcaaattcacagtgatcctcctgcctcagtgtcaggaggatttaacatgagctattatgaaccatgctgcaattacagcatatggcaattgataattcagatgtcaacccaccagaggagtgactctgaggaaggctaatcctgtccagacaaggcctgcaggacattgactctggaaactgctgctcacatctgctgaagcagcgtggtgacttcccaatacctgcacggcagtgtatgatctcatgcgatgtgtatatgtaatctcatgattgtatctagatgtcatgggcacatatatttgtgggtggtcaggaagatgaccttcatttagctatatagaatatgtgctgggacatgcttcataactacatctatttgtcccacgagactgtagacccttaaaagcctcctttgttctttttgctcagactaatatcagaaaataacaaatttcttctcagtctaagacaaactgcacagaattagctcacttttacctcagagcaagttcaaactaaaggctttttgtaaacagatcatacattcaaaactttacagctatgcacaaggtcagagtcacaggggtcttaccaaggttactacacaaagcaccctaagtaaagtatgccaattcttctcttgacagcctgctaacaatagacctgtgtgttatgataaatctttccgccaaaagccacctgagtcctactgccacgtgggtggtttccaccagcagcctgagttctgcccggcgaattagggccccaattaatgcacagagacttatattaggtacaaatgctgcttggctaatgactaagatttatattttataagacttatcttccattggcatcctcccttgccggtgaattacatggcaactctggaggaagagagggcccacttccttcttccattgtttatgtatggctctcactgctaagtcacttcctgcctggatcatcacttctttactacatttcccagaatcctctttgactcctagtcctgtctaacttgatgcctcattggccaaacagtactttattcaataatcaataagatgaacatacacagaagtacattccccatcatctatgtctcaaagtttgtcactggtcactgtgttcctccttctcccctcaatctggtcatgatcttactcctggaaccttggaaccttgtgttgccaagacaatgacttggcaccttactgttttaccctaggaatgtgcttttgaccaatgagaggtaactcttgtaattttttaaaatctcttcaaggctcctgtgaaaaacagagtttttagactagaggagaagctaggaggaattagaattaggacaggggaattagaacagaaacagcaaaataaagagacttgtttgcaatagcacagtgtgtgaaagtgcatgttcaccctcagatactctaagaagaaaaaagttccttttacttgctgttgcattgcctttgaaccctgaagagagtcttggtgttggacccctgaagactcttgttacctcagctttttgagagctgggatatgcttgtaccatcgtgcctggctgtgaactttttaaatttcagcacaaagttaaaatttaccttttgagtaattctgattgaaaagctattatttaaaaatatttaagatgatcactggccctgaagccaaatgtcgtatctttccactcatctttgctattgaccattctcatagaagatagttgttttctcttatgtttaaaaaggtgacaggcatcccattttagaatcaatagttaaaatttaatttgagtgaacctcgaggttatcttgatatgaaattgtttcatttcagatatttgaaactgtaagcagttttaaagaaaaagtattagcgagattctggtttttgctctatctagaggttgcatcccttgccagtatttcttacattaaacacaactctaagatgctatgagacttgagaaataaattggaagtttgaaagattagttcttgagcttttggggcaattgattttggcatggaaggaaagagttgatagtgagcacaactatgtccggaatgcctgtctctttgattttcatattttaaattctagtggtaactagagaatattcctgtggtggtgactttgagtgtatctcccccaagaggctcatgcattgaagacctagccctcagtgcaagccgccttcagaggtggggtagcgggggaatcacgagggctctgggattaatctgttgatggagatactatttgaatggactgttgggaggtgtggcctggttggaggaagtgggtcactggggtgtgtcttgaggggggtggatgtccttccctgtgccttcttattgtgaactctttgcttcctggatcctctgaagtaaatagcccaccattctgtcttctctacttgtggttacacccatacacaactcaggtccacagtagcagagccagcctgcttccaactaaatcctgtgacacctgagccaaaataatggtttcctcccttgagctatttattgaccatatcttgtcatagcacaattcccatttccattcagaacccagagaatttgttcatgggttcagaacctgtggctcaatggtcttgcagcaaacgacaccactttgttatgccaatcccctgagctgtgtgaggtccacttttataaaccttcatcggttggtcacaacttgtgaaaccctatgccaaccccatcttttctcagtgacacatctatgcacatggcagcccatgtttattgcagaggtacacacctggtgaagggcaggtacaatgattctaaagacagcagctattatcttgctttcttcaactcaaccgcctacagatgtaggcatccagaggaaaatatccagtacctgattgaacacattcttttggtgagcaattgaatgactaggaagtacttccctgtacccacgaaactgaaatttgtctcctgccaagctgaactcaattggccctgccctccttccacccgagagcctgtttagaacagggccacaggcatcacatcccatcctctgtgttccatttccatatggttgtcttttgggtaaccatgctttgcctagcctgcagatctaatatctccccatgggatctggaggagaaactgcattttgaaatggactccttaagtgcaagaagaaagaacacttccttgcctgtggctgggatgatctttggcatccagaacagccccttgaacaaatacatcattcccaacacaaacctctctgtttcttgttgaaggtagtctgtgtataacaaaacccacaaagcacactgtcaagtagcagttgtttccttgtgatcacaggtgtgataggcagctgtcacccatatcacagcctagtgtggtggtttaaatgacaatggcgactaggctcatatatttgaatactcagtctccagttggtggaattgtttaggaaggattaggaggtgtggtcttgttggagaaggtatgtcactaggggtcagctttgaggtttcaaaagttattgccattcctgatgcttgtggatcaaatgttttaaactctctcagttactgctctagttccatgactgcctgcctgctgccttgcttcctgccatgatggtcatggattctaacctttggaactttgatccacaaatgaaacactttttttataagttgccttgatcatggtggtttgacacagcaattgaaaagtagctaagacatctggtgtcacaggaatgtattgcatatcacactagccctagaaaagatcaaaattctaaatacagttttgaagaaatacaaattgcttttgtgacatctttgcatgtgttctcatccatgtgtgagcagctgagagtgcagataggtgagcatgtatgtgtgtgctcatgtacatggagtcagaggtcaactttgggttttgttccctaggcaccatttatattgtatttttgagacagggtctctcattggccaagtaggctaggctcactgttcagtgagacccagagatccgcttgtctctgcctccacattctttggatggtaaattccgtggctggtttgttctgtgagttctggggaatcaaactcaataaggcataggtgccttattgtaaggcatgcactttactaagtcaccccaaccctgttctgtgtgatctgtgtgacagagagaccattgtttgaggcctgtcccattccctgaaacagagaccgtttgcttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggggtgggtgggggggggggggggtctctagaatcttttcttcaagctgagctcagttttaatccagagacaactaactgtgggcttccctttattaccacctcacagttcttctgtctatggtgatacttgacatttttgtgtggcacctgactgaaaccatttcccaggtctaagttaatgaggctgtaaaaatatgactaatttggaataattatcttagtgaccaaaaaagcagaagttgccaacatttcttctactactgaccatttatgtctatatagcatctctgtccattttcacttctgttatttgtttttggtgtgtgtgtgtgtgtgtgtgtgtgtgtgtgtgtgtgtgacctgtatggatttcttatgtaccatggatgttaattcatcatcagttgtgtatcccagtgtatttttttggaagcacaggctgaattctcattttcttggttgttctctctactgttcacatctgaactgaatcttgcacagagagtccagtcttcctgtatggggattgataggttagtagattttttttaaggtggtcctgttaagatccctatgcctggttatacaagtgaacactaatctaagtactgcttctatgaaggtctttgcaggttgaattaaagtcccaaaccaattcaccttaaactatagaggttgctggggtgaacttgggtacatcttgagagagctttaaccaggcagaagagaaaggagtagtctgaaggagacaacaggtgaaaatgagtctgttggtttgaagacagcggaatgataaggaatgtggagagtctacagggggaacgctcccatctattattaacaaggacgtgaggacattgtccctcaccaaccccaagttagaaaatgcctgtccagcactttgacttttgtcttgtgagacactaccaagaaaatccactgtagcctcagaattctgacccacagaactgtacctggataaatgaatgttgttttgaggcactagttatggtaattagttacagtgtggtataaaatgatattctagtcacatgctcatgtcagatgcttacacgtgtctatcctctcctgtttaattgctatcttagaaaatgttgcacacacttctatgttactttagcgtctttgtgcatgccatcttaagagctaactagtaggtctgaaatgggtgggttagagggtatttagtaaatacccattgctgatcatttggttcctttctggtttgaatactttatttcgtttttatttgtgtgtgtgtgtgtgtgtgtgtgtgtgtgtgtgtgttagtgtacacgtgtgtatgggtccaaccgaaaccagaagagatcatcaaatccttggagctcagagctgcaggcagtcatgagctacctgatgtgctgggaagtgaactctggtcttctggaagaacagcaactgctcttaaccaatgagtggtctttctaggtatttttctctattttatgagaaaaagaatatctttgtgtatctgacttcctaaggatagactgtggtggtagtcaagacggattcagaaggtagaaatgcacaaggtattcatggtcacgtggtccattctgtgattttccaactggatgtagccttctctggagacattcaggcctatatagttactacgtctggagatggagatcaaatggagtgaaggcacaagtctgcagaagtgggaagctgcaaacaaatgcaaaatacagcaagttgttgtttttattttatcccctttccatatttcctgacaatgctgttgtcccttgggtgtaggctcacaccatattttctttctttggctgttatttaatgatattgggcatttcttctttgaaatgatatttctctgtttgtcacagtttggtattgatgacaccatccttgctgctaagaaaacatgaggttataaaagagacatttgctaagtagggggacatcagagtgccagatcatcttctgtatacaaaagatgaatcaggagtgtaaatgagtgagtgagtctctttaaatgtctatgcagctaggagagagagagagagagagagagagagagagagagagagagagtgattctgtggtgcaagcatagaggataaaggtttcacaactgttacagcttttgaattagtgagtcttgaataacatgtatcttaaagagataaccggaacagatctaaatctctcttagtatttttatacaagatacttttctctgggttatgggcaaatatctgacaataggcagctacagggaggagggtttatttgggctcacagtctctggaaggtgccatctgtcatggtgggaagtgtgtgaggcagcttctgactttgcactcagtcaataaacagagtgtgggggatgggcagtctaacctcaaggcacacttcagtgacccacagcctacagcaaggctctaccttctgaaggcagacagccttcccacacaacacctccaggggagccaagtgttcacagacattagctttgaggacagttcacacacattagcctgtggggccaagtattcacacacattagctttggagtcaattcatattcaaaccacccagtcctcccttagttttttttggtatgcatggtaacttagaaaaacagggatttattttgttacctcaggaggccaacaatcagatatatagagctggcagagcatattctctgtggatagaacattccaaactcatccagcttctggtggatctggtgttgctggcttcccctttgtaacaaattcactctagtctgccttcatctctaccctgcttctcctctgagcctttctgttctttcctctgtttgataaagacattggatgtataacaggatgacctcgccatgaattctttaaccaattatatctgcacagatccttgttccaaataaggcatatattcaaagaccccagggacttaaaagtagacacaactttgtgggtctaaaacatcagtttgctatagtccttaatttactataagtctcctactggtaattgttcataaggtataatttatgactcattatcaactagtttgaaaatatttttagagtgtggctaagcacatgattatgatagacagcagctttgcttgatggtacaagagtccagctccctctccttcatctacatgggtgtggaatgccacagtcaccctctgtgcagtgcaataaacatatattggagattgcccactccaaaaaacacaagcacagacatgtggtatatcatttgtacatttccatacatacctctgtaggattatagtctctttattcaaaaagacaccaaggcaagatacaggccagagctaggttatagaacccagcaagcgcggccagaacaaaagggggccagggtccacacgtgcagccccttaagaagctcccttacgtcaccccggctttccttcaccacgcccttatgggcgagtcccgggtccacctggtacctgtcccaggactattgggcggggctagggtgtcttcctatatacctcctccaatatggctgcccatgtgtatctcctcctgcatggctaacttacacctcaccactgatacaaatttggaggacatgactgttgcatccagcaaacttctacccagggaggaacaatacctcctcaaaaccattccctatgtcacttgcattttattttactgcagatttttttatttggtttagaaacaagagtgttttacatgacaatcccagttcccttctcccttcagtccttctcttcccccctgcccccaactaaaaccctacctatcacatatcctttctgctccccctggatggtgaggccttccatagggtgtcatcagagtctatcatatcctttgggaaaggggctaggcccaccccgtgtgtcttggttcagggagtattcctctatgtggaatgggctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattttggagatcagccctctgttagatgtggggttggtgaatatcttttcccagtctgtgggctcctgttttgtcttgctgactgtgtcctttgccttatagaagcttctcagtttcaggaggtcccatttatcaattgttgatctcagtgtctgtgctactggtgtaatgttcaggaatcggtctcctgtaccaattaattcaagggtattttccaccttttcttctaataggttcagtgtggctggatttatgttgaggtctttgatccattttgacttaagttttgtgcatggcaataggcttggatctacctgcagtcgtctacatgtctgcatccagttatgccagcaccatttgttgaagatgttctctttgttccatcgtataaaatttggattgtttgtcaaaaatcaggtgtttttaggtgtgagagttaatatcagggttttcaactctattccgttggtctacctgtctatttttgtgccaattccaagctgttttcaggcctataggtctgtaatagtgcttgaaatcagagatggtgatgtctccagaagttcctttattgtacagggttgttttggctatctggggttttttgtttttccacatgaagttgagtattattctttcaaggtctgtgaagaattgtgttggaattttgatgggaattgcattgaatctgtagattgcttttggcaagattgctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattgtgcaattgggtgttacttaatttccatgagtttgtaggttttgtgtaattcatgttgttgaattctaactttaaagcatggtggtctgataagatacagggggttatttcaattttttttgtatctgttgaggtttgctatgttgccaagtatgtggtcgattttagagaaggttccatgtggcactgagaagaaggtaaattgatttgtatttggatggaatgttctatagatatctgtgaagtccaattgcaccataactttgattagttcctttgtttctttgttacgtttctgtctggtattcctgtccagtggtgagagtggggtgttgaaatctcccactataagtgtgtgcggttttatgtgtgatttgagttttagtaatgtttcttttacaaatgttgatgcctttgtatttgggtcataaatgttcagaatttagacctcatcctgatggatttctcctgtgatgagtaggaagtgaccttcttcatctctcttggttcattttagtttaaagaccaatttgttggatattaggattgctacccctgcttgtttcttgggtccatttgattggaaaatcttttcccaaccattaattcttgggtatcttctgtctttgagattgaggtgtgtttcttgtatgcagcagaaagatggattctgtcttcttatccattctgctaatcttgtctttttatagtcgagttaagaccattaatgctgagggatattaatgaccattgattgttcattcttgtttgtttttgatttggtgatggtgatgaaattatatgtaggattctctccctttttccttttggctgttggtaaagtgggattatctattgcctatggttatagttaacttccttgggttgcagttttccttccagaactttctctatggctggattggtggatatgattgtttgaatctggttttgtcatggaatatcttgtaatctataatgattgaaaactttgctgggtatagtagtctgggttggcatttatggtctcttagtctaggtagaatatctatccaggaccttctggctttcagagtttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgtctttctttaggttgtgaaagttttcttctatgattttgttgaatatgttttctgcgcctttgagttggatttcttcaccttcttctatacctattattcgtaggttttatcttttcagtatcccatatttcctggatattttgtgctagggattttgttggaccatattttctttggttgatgagtctatttctcctagtgtatcttcaactcctgaaattctctcttccatctcttgtatttttttggttactcttgcatctgtatttcctgatcctttacccagcttttctatttccagcattccctcagtttgttttttctttattgtctctatttcagttttcatgtcttgaatgttttccttcattgtttgattatttttttcttggctgtccttgctttctttaagagatttgttgattccttgcatttttggtgtaattttcttacacttctttaaggggttttcttatatcctatttgagagcctctatcattttcatgaagttgtttttaaggtcattttcttctgcttcatctgtgttattctgttcagtttgtgctggtatagagcctctagactctggttgtctcatattggttttactgttgttggatatgtttttatattgtcttcttccggtttcgtctttgggtggctgtagaaggactctcccttctggtagttgcaaacaggtccaatactcttatgtctctcctcttcctgtgaatacactgttaccagggccttggcagtgtcggggtctgttggatcctgctgccaagttcggatctgttgagcagacccttggcatcagatgtttcctgtcacttgcattttaaataaggtaaagtgcatggatttgatattttccttgggaatccataaagtctgtggagaccacaaatgcagttcaaagacatccaacttactaaatcaaatggaagagtaagtaactgcacgaaattaaacttcagtgccccgtcccctacattcgatgatctaggcagttttttagttgtgtctcaggcttcttaattatctcttctctgaaacttatgtaggaccatgtgctcaaaactgtaaagctgaaaatcccacatcccagactctccacaatcttggacaaattgggacccaggactttggtttccccagagactgatggggctctggtagaaagatatagcaagaccatacctgcagccctaaagaattcacattctctgagatggcttatgcctatcctatgtgaatttattcatgttcccagcttcatcttaccaccatctcagaagcttgtggcttctgacccaggtgagcccatgctctggcctattcttgtaagcagctgcacctggagttggctgtttgcctcatgatttcaggtatccaatgcatccaagaaaacatctaatttgcagttttcccagatgttattttttttttcactgtaagaatgagagccgtggcctcttacctcaatacatcttccatctgaaacaagaagttgtcgtaagcattttaatatccacaactgaaacaaataaatgtgggtaggagtggtaggtctgtctgcatggttgatcgtgacatgggcatccagcacatttagtgcatcaatgtctggcatacagatgagtgtgtgtttggacattcatgggatctgctagcagtgtttgcaatgtgatcaggtatgtatttggtacttcgaggtactggggacagaatgaacactgggatgggagaaggagctgcttggtgaggggccaggtggcacataaccagggcaaatgcatgactccacatctcctggattttagatatgtcacctgacttgcctggaaagtctgagccacccttctctgggggtgggaagctataactgtcaaggtggcttcatttctcaatgagttaagggtaataatcaggcttgggtagttacaccattgacaccattgtgtgtattctatacacctgccaactaagcacaggaatgagcccattgctgatacttcagccagatccctgtgatctagtcagctttctttctgccttaacttccaacttctggagtcactttgtgctgttaaaaaacaaaacaaggtctggggtgtagctcattgtaaagcctccaaggacaaagggttcaaccccagcactgaaagcacacaaatgaaaaacaggcatggtggctcacacctgtaatgccagcacttacaagcctggggcagaaggattgccatgagtctaaagccatgggactacatagtgaggtgcaggccagcctgagccatagtatgaaactctgtctaaaaacaaaacaaacaaaaaaacctacaaagactacagagaaagaaaaggcaggataaacccttgtgtttcttcacacacaagatagaaacaaaaagagcctttttaataaagcttttgcaatatacgtgtttaatagaatcaaaactaagtttgcaaatgaaaattagtactttatttgtctttatatatatttatgtagtaaaatctaagctttttggcatgtttatggaataaatcttctgataattgatattatttacttctctaaatgagccattaaaaaaaccctttaatttgggatttacagtgttctaccttttgctcaaaccagctgctctttttcttgccctccccctaccagtcatccctgaaggacctctgctacacctgaacctctgcctgagaggtgatgacattgccaaatccatacacagagatgtggttggagttcccacaccaattcttgtctccaaaagagagacactattaggaggtatggttgtgttggaggaagtaggtcattgtggagacaggctttgaggtagcatgtatgctaaagtcatgcccagtgtctcagattacttcctgtggcctgtgagtcaagatgtaagaactctcagctccttctctggcactgtgtctgcctgtgtgccaccatgccacaccatgaaaataatggactaagcctctgaaactgtaagccaccacaattaaatgttatcctttgtaggagtagccatggtcattctgtctcttcacagcaatagaaaccctaactagaacaaaagttggtaccagggactagggcactgttgtgatagacctgaccattttgttttaaagaaatatggaccttggggctgttgattagaaaagccgtcaaacatttcaagagctgcttaatgggccatactagtaggaacatggaagacagtggtgctgagtgcgatttgaactgtgggggtgcctagctcaaaaattttcacagaagaatttttaacatgttgctatagatcattcttgtgttattttgatgaagaaggtggctgtatttttgctcttgtccaaaatgtctgcttgagaagagatttaggttaatcccattggcaaaggaaatctcaaaacagcctagtatatatatactttgtcatgtggctattagtggtaactctaatgaagattcataatgacagggagaaagaaaatgcaaaacttgaggagaaaaggaaaatcaggaagtggaatggaattaacgtctgtgttcagggatataaacattaagaaatggaataaaggggggtggtggcctcagggcaagatcccacccagccaagtttccaatttgtgaaaaggaactaaataaaagcttagagctgtagtgtgtggtggcacacaccttaatcccagaactctagaggcaaatctctgagttcgaggccagcctggtctacacagcaagttccagaacagccaagtttaggcagtgaaggttatcattgaaaacagaaagctggtgaagatgtaattaaacaaggggggtgggtatgttccagcacccccaagcagcagaacttggcagctttggccatgtggttctgtatttaaagttaagtacagaataaagaggttagggaatatttctccgcagctagggaaaagcactgaagaaagacatgtgtcaggggtgtccctgaatagaggccttctagagaggccattgcctgaagctgtgaagttgaagcctggattgccttggagactccaagatgttagagatgccagagtcgtgggatgcctgtgaggagagctgctaacagggagtagaaccagcccaagagagggaagtgtgttgcagtcaccaggagctggggaatctgaagagcacttgatgtcagacatggagacacagtgtggagtttgcccagctggtttacagtcttgctttggtccagtattccctcactatgctcccttccctatgttttggaatggtaatgtatatcctgtgccattatatgctggcagtatgtgatctactttttgagattttgattttacagaggattacagttaagagagttagagaatctcaaaagagactttcaattttagacttttagatacgtttgagactgttatagactatggggacttttgaagttagaaagaatgcatttttgcattatgatatggctacaacaagcctttgggggccagggagtggaatgtggtggtttgaaagaaatgccccccaaaggagtgtcacaactaggaggtgtggctttgttggagtaggtgtgcccttgttggaggaagtgtgtcactgtggaggtgggctttgaggtctcatatgtgctcaagccacacccagtgacacagaccaattcctgttgcctgtgagtcaatatgtaagaactcttagttccctccccagtgtcatgtctgcctgcatgctgccatttttctcactatgaagataatggactaaacctctgaactataaacctgctcaattaaatgtttttctttataagagttgccatggccatggtgtctcttcccagcaatagaaaccctaaataaggcaacaaccttcatttctcagtgcttcctgatctcaatgtgaccacccacataagattcccattgtcacctcttcctgtcaattgcatgctcaactaaccctttcttcgctcatggcagctatctggtcataacagcaaatcctgatatgtgcagtcacagatgtttaaatggcatgtgtattatgctagtatttttgagtataaaggaaaatatctgtgagaggattcttagaagtgaagtgctcctgctcaagctggggacaagtcaccccaattttctgaaattggacagtgttgtagacattgacggttctttattcactgcatggactttcacaagtcattcctattttggtgatggtggtctagagtggaggaagatttcaggctatgaccagcctacaagagacactcctgatgcttcctccccccaaaccataagtcctaacaaaccctctttccttaaactgattttgtaacagcaacaagaaaatgaatcagcagaaacaccctttgtatgggtagggaaactgacgtgttgctatatacatttgtctaaacaaaaatgttctagggttcataggcagttggtagttggtgggggagaggggagtatgttcttcgttggtaggcaaggcactggctagttgtcttccctcctataaacccttactcctgtaagaaacaacacagaattcattggtcacacaagcatgcacacagacacagacagacagacagacagacagacagacagacagacacacacacacacacacacacacacacacacacacaccacacataccccacactacactacacgagacacgaaagtaaaaggagacctgactagttgggagtaaaggcaagcaagcatagccatacacattatatacatgtgcaaaaacgtctcagtgaaacccattgtcctgtataattaatatatgctaataaaaacattgaaaatattctagtaattaaaactcttgccagtgaagtcagctccctttgggcatgaagagccttgatctgctcatagatttgtataaaaaggttgaatcacagggtcagcagtattgccaaagcctgtctgcattgagaattgaactggaggaggcagctgcttgaagactccatggtaataagaaatttttattacaaaccccatttatgctgaaaaccacagttttcttataggtcaacaccagtggggaatgatgcacggtaatagaaaatacctggattccctgcaggcatcttcagcctcttttcttcctcgaggttggctctgcagggaaattacacctttctcttccttccactttggatcaggtgtgaacaagatttcagaaaataacaggaaggggtcatctgggctggtcctgcgtggttccctggggatgagtgtggcttactccatccaagccttatgtgtaaggaaagtgccttccctgttggttagttctatgacaccgagataaatatggtagtctgcagagcagttgtggaggtaggctgcgaagaagcaccactctgcgtgggcgactccagcacacggtgggttgggaagacgatattgctatacagctgtagctttccaagctattcttgtgtctttcttctccccagggctcaaatagctgtgggttatttgtcctttgagatatatgaagatgaaaacgagatgcataaaatgtgaatcaggccttgtggtggtggtgcacgcctttaatcccagtactcaggaggcagaggcaggccgatctctgtgagtttgagatcagcttggtctacaagagctagatccaggacagcctccaaagccacagagaaaccctacattgaaaaacaaaataaaacaaaacaaacaaacaaaaaaaaagtgaaccagtgttgtctacactctgtgtgcaacagcatggatctacttttctggcttttttgtttgtttgtttgttttgcagattttttaaattgaattagaaacaagattgttttacatgacaatcccagttcccttctccctccagtccttccctcaccccctccactcaattaaaaccctacctatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgttttgatttgcatttccctgttggctaaggatgttgaacactttcttacgtgtctttcagccattttagattcctttattgagaacgtctatttagttctgcaccccactttttttattggattgtttggtgttttggagactagcttcttgagttctttgtatattttggagatcagccctctgtcagatgtggggttggtgaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaatcccaacccaattcttcacagacctggaaagaataattctcaactctatatggagaaacaaaagacccaggatagtcacaacaaccctgtacaataaaggaacttctggaggcgtcaccatccctgatttcaagctctattacagacctaaaggcctgaaaacagcttggaattggcacaaaaatagacaggtagaccaatggaatacagttgaaaaccctgatattaacctgacacttatgaatgcctgatttttgtcaaacaatccaaatttatacgatggaacaaagagaacatcttcaacaaatggtgctggcataactggttgcagacatgtagaagactgcagatagacagcctatcgccatgcacaaaatttaagtcaaaatggatcaaagacctcaacataaatccagccacactgaacctattagaagaaaaagtgggaaatccctttgaattatctggctttgttcttaaagtttgtgtaaatcagctgtgctcttaaagagagccatacatgcttatggaaagtgtcctttgacattgatttagaacctttttctgtgaactaagatcctgtccgagcatgggttctcacatgaggttgtgtcacacagggaacattagtgccccttggtgcctgataaacagcataggtcacacctagttcattgtttatggatctgtgtttcatcttcagagactccaaagatggatgatggattttcagaaagctgtcacagatttaacacacacagctacactagtgtgtacctgtgaaatcaccctggtaatccctcagccctgtgcatcatatctggaacttagaatggtagtttattaggtcaggggattgccaggaaggggacaaggccacaccttcccccttacgccaagatatcagggaggaaaatgcttcccgagtcacagcacagtaagcatgagactgctgtctgctcttttcactaaaaatagttgcagtttcatttaagaagtcacactgctattaggcttggttatcaacttaattatcaaagtgcatctctgagtgtttgtgatggtgtttttgaggattaactaaacaggaagaccctcctgaatatgggcacaacacccacaggttggggacccagacagaatgctgacaccaggaacaggtgggctttgctcctagacagatgagcagcctcagatgtgtgatggctctgtgtgctcacagctgggggttagatgaggtcaaagcatttcctcctctgcacagttgtggggagcattttgttaagtttaccaggcttgaagaagtcagagtcaggccattgtctatcctctggagtacattattgattgcagaggctgcctatctgacagttttgagacatgcacctggagcttttgtaatgctttgctataaaacaaacactttattagattttactccataggtcccgacagctgtcatgtaagctgagccactcactggggctctggagattagggaatttgtgtaagctcatacaaatggccactggagagaattccacaagtttctctttccagccatctcagagcatacaggacacgggaagccaagcttacagggctcagtatgactgtcctggaataccagagctgttgcttcaaagtgaatgtgccagttgctgattgtgatctcagggagggaggagtgggactggggaccgacagccgttcacaatctactgaagtcacagcgtcattcctatggtgcaggtgcagctctctggccatggcatcaatggacctggagaataggagccctagattaggaaggaaaactttctcagcacccccaaccccaattcttggtatatgattccatagtaaatgagggtctaaatgctgtctattttgttgttgttgttgggttttttttttttttttgcctcttcttgctgttcttcactatttttaaatggtccatcttaagggttcctagtcaatgttcacgagctgctgttgttcatagtatctcatgagattcagacaatttcagtgttgttcgatgtacttttctcatcactggcccaccatttgaggtccttcatggcagaggaggcatggcggtgggaatggaaggtacctggtcacatggcatctgcaagcaggaagcaaagaggtgaatgggctgctcagcttactcctactgtcccccttttatcagtctgggatcccatgggatggtgccagccacattcaggtcagcctcttaagctgggtgtggcccctaagtgattctaagtccattcaggcaaactatgtagaagaacaacgataaacatttcattcaggaacttgtggacatggagtgagctggaggaaatatggaggagctgttgatactacgcacatagtgggtcagattattttcttttgcaatatgtgattgtagcaaacatcctttggaagagagaataggtgaagaatgataaattgtgtctctgtgtatggctggagtgcttttccccctcactcctttcgggtgatttaggaacgcagtaccaaagtttgtttgcgtgaccttacctcccttctaatgccactaacaaagcctcctctgcactttgtaatacaaataaagacatgcagatgtcataggtctattctttggaccaccagctccgaaataacgacacatagactttttattaattatggaagcctggccttaacttcttaggcttgttcccagctagctcttaaaacataagttaacctgctgacattaatctacattctgccacatggttcgttacctctcctcagtactgtaggtccaacttactgcgagtctggctggcgaatctgccacctcagattctttccctgagttcctatctctccctggaagtcctgcctatcctctcctgcctagctattggccatccagctctttattaaaccaatcagaaggttccccatgcaggtgaggtaaaatggagacatgttcacacagtgtgatcaaatatcccacaacatgcagaccttgagctgggctaaaagaacagacatcaactcccctccccttataagatcctcagagaggaagagtcagcaacaacacatgtgtgaggaaataggtatgaataaagtgctctccagagctcctcttcttccataatcccaacagaagttgaaactgaagaggaaggtgacaattaaatcttttaaaatgatgttacatacttttaaactattatgcttaaaaatggttatgataggaacctgctaagccagacccaggtttgaatctgttgggtgcttgatctcaggtactcccacaccatttttggtttgcatttttattatacaaaactttctacaagtaagaagccaggaccaaatttttaggttgcatttatatggccacggagctctatctgggactccaggtgactccttctttcacagttcatatactatttgtagtttgtcctttccacagtgctcatttgtagtaggaaatgtatttgttatttacttagtgggccatctcttctaccatgcgacggcccttgtcagttacaagagtgtatgaacacagagcaaagacatgtcctcaataggtcaggttgatatgtgtggcactgcagagctgttcttctgacttgagtctctgctcttggggtgtactttcaatacctcatgtttatacagaacttaaaatctcaggtacagcaatgcctgggtttgaaacagactatgagttatgaatataagacctggattactctcatagcatggtaacattggtttcagttcttcaggtgtcctgttaatctatcagtgttatttagtgacctagtaattttatttcctcatatagagaaccatttaattaaaacaatagactgtgctttcagttagactccatataatcttgtggatcaacagctggactgctgagagaatgctataaaatacttttatagccgggcattggtggcacacgcctttaatcccagcactcaggaggcagaggcagaggcaggtggatctctgtgagtttgaggccagtttggtctacagagcgagtgccaggataggttccaaagctacacagagaaaccctgtctcaaaaaaccctttgggaagagatggtgacagaaggccagagaggaagctgagagatcatttctcaaccacacacaggaaacagaaatcaaacaggaagtggggcatggctctaaacccttggaactaccccagtgttgtacttccttcaacaaggctgaaccttctaaaggttacataacctcccaaaatagcaccaggaagaagttatagcaggaactcaagcagggcagtaacctggaggcaggagctgttgcagaacctgtggagggatgccacttactggcttgttctcacagcttgttcggtcttccttcttacagtacccaggaccaccagcccagggttgccaccatttataatgaatgggttggatcctcccatattaattaagaaaatgccctacagctctgtctacagcccagtcttcatggaagcattttctcatttgggcttctttcctctcagatgactcttatcctatgtcaagttgacataaaattaaccagcacacatgggaagatattgtgagtgaatgtacctttgtttagctataactcttgaagcttttaacaatgaacaaaaccactagatttagaaccctgcagtggcatcttgccttgtcaatgaacttgtagtagtggccacacctttgggtgtggtttcaggtgtaacgtgaccccttcaaggcagaggagtggcagtggtgggcacttgctttcttgggtcaccgagagcattggaagggcagactgcatcttctgaagcagacaaaacacggcagttatttgctgttatctgtgtaagttctcccctaataaaacacctatttatcatttatctggggtctggtgaactcatttaagccccaccttcagagccccatcattgaagaagaatttacaaaagttactaagaatctggatatggtcttagccaatactgcattctgctctctccccttgagtattgtagctgagttgaaaagggctcctaagctcagcttccagggacctctttatggtattctcaccaatccagggtgggggagacaggtttcttgtctgtagaatcttaaagtatttttattgggaggtatttccagattcttaggaagacttctgatgggcctactaacttctgttactgcttgttaataagcagaatgaggagacaagatattgtgcgagctcttagcactggctcagagtacactgtgagcactcgtgtctcctcagatttctcacatgagttttggatgcatcttttcttcaacttttcattgttttgacttgagactcactgttgccacagattcataatagtgaccttaagctttggagacagaaatctgatctattctgaatatttgtactttacaggtaaaacaaagacagaccaatgggtcaaagtcagagtggattcaagcatatgttaacatgttgtggtaggtttaccatcactgtgcagataccccagatgaacaaacatgaaaagaggaaagccttattttagctcacagttttggagatttcagtgactggttgtttgctcccattgtcctggccttgatgggagcaagtggaagaaacagaaagagacaggaaggaatgatgtcccaatgtctccttcagggacacatccccaatgacctaacttcttttcattgggacttcctcctagaagtcctgccaacttccattagcataagagtgaaccaagcctttcaacacacgggtctttaaggaacatttaaagttcaaaccataatacgagacactaggaaaaccacaacttagatttaaattgctttttaaattgatgttttaatgtcaatcatagtctaaattgtttctaaagccccacatggttggagctttaaaatcatacagtgtgtataatcacatctgatggtgtaggtaggcattagaatgtggtactgataatggaaattaaattgtgaacgggcctgtaagatgctatagctacatatatagatgactagtgtctgttccaattcccaaagtcaccctcagtccagcatttgatatggagctgggcacatggtctaggagtttggatgttacttgctgatttcccagtcttcaactctgtttcctgcttttctatttctcattagttcagaccacagccaagagtttgatgatccctattcccaaaaggcatagctaactataattatcattatattttaatgattaatgttaactatttcagatgatggaaacattttggggtaacaaaagtgaagagcataggtctggaagatggctctcccctacatttcattcactgatacaactggagaggggagcttgaaaagttccgaactttagccagatttgttgaaaagcaatgaatgatacagttgccataaactaatttaaaaaaaacaaacaaacctgagttgaaaagtaagaatgaagagtaagcttttagtaatcatgctacaaaacttactgccttggtttgtgagacaaagtcctgctacatagcccaggctagcctcaagtctgtggtattcccctgcctctgccatccaagtattgaattgcaggcatcaaccacttcacccagccaaattttgttcttgttttgtttgttctgtgattagcttttgagaatgagtctcctgtaacccaggcttccttcaaacttgctggggagccaaggacaacccaccacctcacacattctgggattataggttgcactgccacagttagctctaagtttctgcattttaatgcagagaactaagctcttttacgcactagactggactccagatgtcatttgcaaaaggagctggtccctatatatggagacttgaataatggatttgaaatgaccttccctgccttgactattctctacttccactattcaacattttcttatatgtcttacacttattgacccctaatacattctaattaaatggatcatgatgccaaagccagaaaataaaaattggtgcaaaaatcatctccctgtctttgtacaagaagtgcagtttgtacaaggaatggtttcacaataatgcctggtgacatcctactaagtcagtctggtttgctgtattttgacattggaaaattctctgattcggctgaaagtgtttctctttttccagcattccaatgactgacagtttctatttataactggttttatctccccacagaagcagtaagatgttctcagttagaaggttatcaaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgtatatgctaggtaagcattccatcaaccaagctacaccctcagtcccataattttttaaaaaaaatgtatttttaaatcttctttggcaatttttcctcaaaactttcatttgtgtatgtctatactttgctgttctttcccacgtatcagaatgcattgtggttaaatatgacagagtttcttaaaagtttaaagttattatcatattgttctgaacagtcttcttgaaagaggttacacgtagggacaaagaggtggtggcacatacctttaatcccagcacttgggaggcagaggcgggatctctgtgagttcgagaccagcctggttctacaaagagaaactctgtctcagaaaaccaaactggaaaaaagaggggggggtagggggagttgttagggctagagttgcatgtctagtgttgtgcagttattttatcccatgaaacattcccttgtaggtgatgagagaagctcctaagtgttaggaagcaaatgaaacacacaaggcccagaaagtaaaccaatcttacaaggctgacaatgcttctgaaacttacaagggtcacaaggccccttcttggggttagagaagcagtaacagtccctgagcagtgcatagctgagcagccaactgcctaaaaccagttcagcaagctccagggatgcaattttcctgagtgggccaggaagtctgaggtgtttaagtttaaattagcatgtctctcctccaaacatttaaagtttgagtacttggttcccagctggtggaactgttagggaaggattagggggtgtggccttgtgggtggaggtgtgtcactggggactgattcatcctttccccagtgtgctctctctgcctcttgctgtggttagagatttgagcactcagctgttcttgacaccaggccatctctcccccatcatggactctaaccctctgaaactgtaagcccagctaaatactttcttttgtaagttgccttggttgtggtgttttcttgaagcaatagaaaactaatggagacagggtcacacagtgcccagtgggcagctgcagagctgacctcctctttagcctgatggaggacagttaattttaaatatgaccctgggttcacacgccttcctagttcacctctagtcccccagttgctttgctaccatcaaggagcggggtttgccacatggggccatctccatatggtcagtttgtgacatatgccaactcagacccacctctcccactcagtattttcaataacacccttccctgcccattcatctaactcctgcttgcactagctcctttccctataaagtgatctactcccttacaagggagcaattttctgatttctgagattcagccccttggtggtgctttgcagttcccataggtaaagagcaggcagagtaggcttctctttctcctggatccatcacaaacagggtctgtaccttttaaaacatgttctgtgtggtttccaagaagggctgaggcaggttgaagaattaaactggcatcaaatttgtgcagtcctgccgcggcgtcttcgtattttcttctcaacctgtttccaatcttcaaaaggaaaggtgtgacaaacgcagttggcctgggatctgagacagatgtttccacagggtagtgctcatctctgttaattgtttcctttagggcttgggaccagaagagtgtagcgggaatttagtgtgaatgtcgaatgctctcactaggccaaccgtggtgcacagttgacttaacctccctatgagtttcctcagttaatcgtggcaaagaagttgaaagggcagagaaatctaagggaggattcactgggcttttgccattttgcctgtgaaaaaggaataggaggtgccaaggagactaacatccgagcctacttggagccagaaatttaaaattactccctctgccaagaaaagcaattacatgaaagttggttcagatatagtttcaaagctgcataatttgaaaaaaaaattcacaattttggaagctaagcacaaatcagatcgagaatgataagaaatgttaatgtaaagaggcacgctgttcaccagggccaagtgaaatgcagtggcgcttgtattttagctggtatctctgttttaaaaaaattatatgagatggaaaaggcataactaccctgatcatggattcatggcttctctggttatctgtgtttagctgaattgccatatgtctggtagacgtggcaagccctgtcttgaagaatcagcacatctccttggcagcagaactgtcagcaagtctgggaaaaccttatgatgcagaagcccatatccaccgtgcacttagacaagagtctctttctgaaatccctcaagtgcttcgatagctaagtgatgtttacattctacaactaattatggaccccatttaaccctaacacccctggccgggcactttattaatgcattgcccattctgccagggtgggtgcacacgccacaggagctgggtgctgtggagctgggtctgcccagcctgggctccagtctgctttgcagacatgttggcactgggctttatcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatagtggagagggttcccaccctgggcctcagctactttaattgctgtatttagaggttggctgttgagccgctaatccctcttgatggcagtgatatttaattggatagaattacattcaattattgtaagtgtagtaaggagtgctatctgcctgtactcattaatttttaaattttttaaaatttctgagatactcaggctggagagatggctcagaggttaagagcaccgactgctctttcagaggtcctgagttcaattcccagcaaccacatggtggctcacaaccatccattatgagatctggtgttatgtagtatacataacaaataaataaaatcttaaaatttctgagatactcgaacttcaaggtgtggaccagatgatttttgtggcttctcatgctaatttaaaatatcataaataaaacgacactctgtggaggcgactagtagctgtttctgaactttgtttttttgttttttcctttcaggaacatttgtcatggctgttttttgtttgtttgtttgtttgtttgagacatggtctcttatagcccagcctgccctaggatggtctaggtagctgaagatgacccttaaactcttggtcctcctgtctaagccaccagagttctgggatgacagatatgcgccaccataccctgacatttgtcacgtcttaacatacctttatgtgtacactgcttttctgctgtgccataataactttaaaaggcacaaatattgtcctgctattaagtagaatctaaatcaacacaccgagtatcgaagcagaaagacaaaaaaatgtgaaaaaatgagcaaaacaattctttctaggaaggtaaaaataccgaacacaggctttgggtgcctgggaaaacagagcaatgcattggcttttgttaaagcatggcacagcagacactcagggtgtctgactgccgctgggctagtcttgacttcactaagaaatgtgagggagggagaaggcatagcacacgcaagtcacatctgtggagtcaaaccaacccagctgctctggtcactactaactaactgggggatgttaactaaaccaaggcttttaaaacttttcccacttggcggcccctttccactcagtaccctctttgcaggtatattagggtatttactgataatagtgataatataaaatatctatagataataaatcacaagggagtttattataaaacagttccttggtgtaaatgtaattaattttatactttattggagagaaaagcaaatttgcatactataatgaaatgaatattcaggcttgtatagcacagtacaatacactaatttgatacttataaaccaaggaacagtggtaagaaaatactagagctttatctttctgggattaaaccattacgtctctgtaagagcagaaggtttttgtgtgctcagtacaaactttgctcttcataacatgagccaagttgttgcattgcttggcgttgcgtgtcatgttggaatgtgtagtgggaagtcctcacattgtgtgtccagaatcaaggctacagtgaagtcatggatggaaatttcacatgctttactttggtcattgtgaattccgaaagctttttggcaacatttttatgatccccacattcagctgcttgatcccatatggggttgctacccactcttgagacacttccgtctaaaccagtgggtgatacaagagaggccgaaactctccagttttgatcagactcctctccagagaggaactccatagagagtggagacatcccagctctgtcagatgacctagcttgtagaagagctagaatttacaggagccaaagatgactcagagcctgtgagacatctgccttctccaagaagctggctgtctagccaggtgctgaagtgtaagtgttacaggcacaaaaagtgacagtgttacaaggacacagagagctgtgtgacccagcagagctctgaatcacagaccgtatcattaaggcaacctgggactccctggctttgcatgtcacacaaccatcttgtgaatcagagtccagactcctgtgtcggtctgatgttccatcttccctcccaggtcagagaccgtggaggaagcagaaagggcaactatgtctggatgtagctcggcggtgccactcttctgaaggtgggtgcaagcctggactttgccccagccaagcacacaaacaagataagcatgacaaaaccagacaatcttcagtggtcccaaaaggttctgcttctagctctgcttcttaccagcttgtgtcaactcgacacaagctagagtcgtttgggggaatgggaacctcaactgagaaaatgcacacccaagagtgtcctgtaggcaagcctgtggggtgcagctcactgtgagtagtgccaccacgcctggggaggtgatcctgggttgtataggaaagcagactgagcaattcatgaggagcaagccagtaagcagtgctcctctatggcttctgcttcagttcctgcctccaggttcctgccctgattgagttcctgacccgacttcccccagtgattgactgtcacttggaatttcaataaaataaaatctttcctccctaggctgcttttggtcatggtgttttatcacagcaatagaaactttaataagacagctaacagctacagtcaaatctaagttcagattccttatttctgaatagccatatcctgtgtattgctagtcctaaacagctcctcacccaaacaagttcatatgatgaacaatttagtaactgtgtagactgttaccttttcatcccctaaccacactgcaggtgtctccaatgctgcaatggattcctatcccctgcactgttacaggaagaatgtaccggttgtgctatgtgggagctatgctataaatataattcacaccagacatttggggatatgtaacgttcaaaatgggggcatcggagaagaaagcaaactttcctcctggtttcttaaagtggcagtgctnnnnnnnnnncactcagtcctttccctcagctcctggccttccccaggcacccctctctccttccctttcccagactaagcccccaaaccttcatcaccaccacatttctccaccctccccagagccagttcaatcatctcttgtctctgtgggagaaacttctagtcactggtcactaccatatgaggctagaaggatggctcaggggtaatggttcttgtcactcaagctgggggatctgagttccatctgcaaaccacacacacacacacacacacacacacacacacacacacacagactgtcctgaaactcactctgtagaacaggctggcctcaaactcacagagatccgactgcctgtcttaacctctttgctcatcactctcttttgactctttggggacctgccaagcaactcccaaataaaacatggagacttattattaattatgaatgcccagccttagcttaggcttgttccattagctcttttaacttaatttcacctgtttatagtcatctatggtttgcctcagggccttttacctttgttccatttgtatgtcgtactttcctgcttcctccatgtctgtctgtctggcccctggcatctttttctttcttcctggagcctaaattcctcctcctacttactctccctgacaggaagttctgcctaaacctcctcccttgctattggccttcagtttttttttaactagatcaatcaggcccccttagacagacaaggtaaaacagaacacatcttcatatagttaaacaaatgcaacatatctttctgtagttaaatattctggagcagaggggagggaaataaaaggtgttgaagacttacttggcagatgtggcactgggaaccactcacccattcttgtctttttcccacacagagcaataggatgagaaagaggcaagttgaaaatgtatatttattcttactgggatcagggctgttataactgagccacactgccccatgcttgcaaatgataagcctgcagagtgttggggaaagcatagaaagttctgtgggtgtttgaaggagcctgtatcggggctgccatcacaaagctgtctggaaaagaaacatggaaccagggcctctctggaccacactgattgtaggtatctttaaggaaggtgtcatgataaagtttacaatggaagagaaggacctggctcatgctgggcagttggatagaaaacaaagtgatttgatggagaaaaaaaaatccatttaagtttggcacctgtccctctacaatctgatgggtagagaaatgtaaatttttttggaccgggaactgctgaactatcattttctttttttcagtttatattaattttgagtttcttcataggtagagctggactagaaacattctgaattaaggaagaaactgctaagtaggcaaagctgtgggcttaccattcaacatattcaagccaagtgtatttagatagaatttgtgcaatagtcactcaatttccagggctgtaggagatactaaaatacttatttataaattagagaacaacacctctcaacaaagccctaagagacagatttagagtattaaaatatataaggaacataaaatgacaaagctagataaatatttggggatgtgtaaatgaatggacaagctataaagtagattactcttgctgttctcaaagccatcctttgtggaatttgttgttattgtatttctgaaatgggtttgggagttcagagaataaattctgacttttttaaaatttaaaaggtttttgttacgtgcatgtttgtgtatctatgtgtgtcatatccactggaacaagagttacagttggtggtgcactgtcccctgcgggttctgggatctgaactttggtcctctgcgacctctcttaactgctgagccatctctctagcccccaagactgagttctgttgtgggatgggatgttacttgaagatatgttatatttgtttatgttatggaatatttgtttaatgatacaaagatgtgttgcactcttttatgttgcgtttgttcaactctgtaaagccgtgttactttgtctgcctaaaactcccaattgctctactaaagagctgaatggccaatagctaggcaggaaaaaagatagatgggtctgccaggcagagagattaaataagaggagaaatctaggcttggcagaagacgagaagaggaagaatgagaggagaggaggacgccaggggccagccacccagccatacaaccaaccatggagtaggaaggaaataaaggtatatagaatagagaaaggtaaaagcccagaggcaaaaggtagataggataatttaagaaaagctggctagaaacaagccaagctaaggccaggcattcataagtaagaataagtctccatgtatttatttgggagaggagtggtgggcccccaaacagaacaaaagacaaaacaaaacaaaaaaccaaaaagaaaaacaaaaaccatccaactttagttctgtttagctcgaagcttcataccagttaaaaattaagtcttggttgtttgacctgaatccaggggcttggtacttatagctttatgactagggcaacttaatttagcccctcatctacccttcagttttcctactgaaaatggggtgatgacaagcaccaaccccaccgcactgctaagaacacttgggttttttgagagaccctcttctttggaggaactgcagcctcacccagacaatttgcttttcatttcttagaactcaggctcagatgccttccagtcatcagagacttgagcactgtgctcagagtccctccctgcctatgtatctatttcacactgagttctgaggcagtgcttggcctcttggtctcttggcgactcctactctattgacctgctcaccccgccccattcctctgtcaaaactttcatgactttagtcttcacatccttttatctgcagtctgagcatctctctagatgccctggaccctttactctctcacaagtttatttttctctgagtggaccacagtatctttttgcttcattttcacctactcagtcactgtacttcacagttcaggtcctttcttcatattgtacatactattgacatatcatggcctgggattccagagagtaacaacacctatattcaattactctagcagggaaaaatatcaataataaactatcaggacaatttccatgaatgatttatgccatggtatgttgtgcaggaaatggtgacacctcagagagctagtagctagccatgtacgagatttggggaggattccagattgtgagaccagcaaatacaaaggttatgaaggggaatctcttgaagggttccagaaatagaaccaagcaagataaagattggacttggggatggaaagagagacaagagggacaatatgagcctgtttctatctggggtttcattttcacctggtctttcttcccaccattgccctgactcttttatccacatgcccagtatttcttagtgtgtctgccatgctataccttgggtcattttgtccaattgaaggcgctcatcatctgtcacccaaactctcctagaattcccaattgtctttaatacaaatactcaactaatccaaaatggaagattaattatctcactatataatatataattctctacaggatgcaaaacccggcttcccatcatgatagaatgttttgtatagtctggtggtaccatctgctaacattgcaaaacaaagcacatgaggatcctctcaactcccaaggcctttgttaagtcattgcatctcatggactctattttttcctgataactgctagaagaaagttttatacttccatacagttataaacagattccaagatggctccacgttcttccagctttttactctcaacattatgtgacccactcttcatcgtctgcaaggcctgtccttgtttctagtcaaaagaacatggtaaaaccaaagggctgttgtttcttccacaactattttaatggtatatcactatttctgggagacttctttctgcttgctttgaaaagggcagctgctgtggtgggggaaccaagaagatgccaggaacaagcaaaactccagtcaggaacctcaggatctcagttgaatagcgacaaccaagtaaattgtgctaattaatactgtcaacctgacaggatctagattcacctacaatcccaattgctaagcaagcctgtgaaggattacctatcactaggcaagcatgtaaagattatctaccacgaattgaggatcatctaccactattgagcctgtaaaggatcatctggactgtgttaataaagttgggaagacccaccttacctgtgagtggtgctattccattgagtggggtcctgggctggaaagtgaaagtgagttgagcaccagcatccatctttctctgtttcccagctgcagatgcgatgctgatcagctgcctcatggtactgctgccatgacttcctctctacgctggctgcaccttctgggagtcagaataagccctccttccttacgttgtctcttgctaggtattttgtcatcacaagaagaaaaataattggcacacagatgttgcaaccaacatgtgcatagagacatgtgctcagctgcccccagtgagatcacagccccagccaatacttcgactgaagctatgaaagactctaaaactgaggttctgagtaagctgtgcttcaaatcttcaggcatcttagcatcatttttcagtccttttcccatctttgttattttagatacagtctcatttagtccaagttagccttgaactcactatgccaccgaaaatgactttggactcttactcttcctgtctctgcctcccagtgcagggaggacaggtgtgcaccccaatgtctatctctttctgcagccctaaagcaccaggtcatgcaggccacatgccattatttctgatggacatggtctgccctggctcacacatccttcaaagatggaattctcctcctcccctcctccccgttgctccccacacctgagtcagacatgtttccctgttcttttcttagcagaacatcgattcctcccagcagacaccacctccctggaaagatggaggagtcagaggtcacactttatacacttaattaatgtttttcattgactgggtcatatttacatccttccttagtacctatatagtttaatttcatttcctaaaaatatttaagtaggattttcccataaaacccccagatactgtttttgggatgagagctcttaacatgtgtaaagagtactaatttctctgctttctgatgagtccctttaatcttttttgtcatcattttcattcacaaatgtatggtcatctttccaaactccccacaattataaagagtcaaagaatcatgcaagatgttggggaaagagcccagtcatgaccaaagcaattgactggccctgtagtctctctctctctctctctctctctctctctctctctctctctctcacacacacacacacacacacacacacacactcacattcaggacatttgaggcccacttttacagtaattctgtctctctgtctgtctgtctctctgtctctctctctctctctgtgtgtgtgtgtgtgtgtctgtctgtctctctgtctgtctgtctctctgtctctctctctctctctgtgtgtgtgtgtgtcccttgttcttgaattagtgacacactttgtcccctgcaccccaaatatctccctaatgttatcttttatctctccagtctccaacttcccctggggaaacttgttgagaaagaagctaattttctctaattgagatatgcaatttgaaattctaattctcgatgatagctttatttcttctatagcatgttggcagttgatagttatgagcagagtctctcttttgggtcattggtgggaaaaattcagctccactaagctcaactttgcacatctaaatctaggcacaacagtaattgggagctcctgtgtgtaactcacaatgttgtcaggagcttggaaataagacttgcaaatgaggccgtgagcgggtgcaccagtcggctgcagactgctgggtacaagcctgagatagctattctgattttttgctgcattttacttttggtcttgaatgtggcagcgtttttcttcctagatgctctcatttcccaggtccctttgccatcagctgtgcagttgtaatagacttctctgtagatgtggcatggccatcaactagggaaaagaaaaaaaaaaaactctcatttggaaaattgctctttacatagaataaatagcccccaaatgtctgttatccccagagctctgatgagtttaaaagcaaaacaccatgccccagtagcttaataatgaatgctatcatctttaacaatggtaatgaaaatgatgtcttaagtagcactctcctaattccgcaagcatttgcacatgtgtgactgtattacatgactacccgaatgttgtgctttggtgcatgatgtaattcctctcttaggataggggctcggagggcacttcatgttcttatgagcagcaccagcagcggagccgcaaagagtctttgtgttttccacaccagcctacgtctcttttcagcagtgcattttctctatctagtcataaataaccttggttcaggtgactcttaagattccaagtagggagcaattttactgctctgggttcccaccacacagacacctctgtcagtcagtcggccattttttcaccagggaacaaatcttcgcggcttcagattttctggagatgggtgaaaagtgcttcatttcattttccatctcagacacaacatccttgtggttgagttgtagggttgcttcccctcctcacttagtgatatttgtccgtcatcctcggccttacattgctcttgtgtttatcttttcctttaaatagtgtgtgtgtgtgtgtgcgtgtgtgtgtgtgtgtgtgtgtgtgtgtacatgtgtgtacatactcgtggagaccagatgtggacatcaggtatttttctcaatggctctccatcttatttttgagacagagttcctcattgaacctagagttcattgaatcagctggactggctggcccatgcattccagggacccacctgtctctgccttctagccctaggattttagaacttcagacctcatgcaagcacttcccccatgcccgatacttgatgatatttatagccacttttttttcaaaatcttttcctatcaaccctatcatctattggggatctagtgccattgatagctttgatagattttctttttggctataggccatatttaccactttttgtgtttctaaccagtttaaccattttttattgtatatggtaagtacttttgggaggactatttgaatttggttatttatttttattatgttgaattcactttggcaactttgaaggttcatgacctaagggcaatcttggagacttgtttctgtattttactgatgcaacactcatctagtatgtcctttacttctgggttagttttgcattgttattattaaaataactcttcttagcctggttgtctcaaatattctgccagtaacaaatcagaaatctaggacttaacagccccaggaacttgagacttgcttggcttttagttgcttttaacctctgatcttaccatattttgctccattcatgtattgatataaaataatgactgtttcaaaggaaataagaaaatagttcattttgaaggtcaacaaaatggcttaggtggtaaggcactcactagcgtgcccagtgaccctgtcaatctccagaacccacttggcagaaagagaaaactgactcccacaagttgactgtcatagatgtacagtggcttgaatgcattcacatgcacacacacacactgataagtaaataaaaaatgatgaaagaaaatagtttattttgagccaaatgtgagtaactacagaaccaggaacatggactcacattactgtgaatgaatgccctaccatcaaagaggtgacatgaactttattgttgcagaataaaagaaagccagaaatcaatgcaccaaatgcgttgatggagaataagaaagtgaagctattgcaaagtggtaaaattgatgagattctgctatcatattaaaacactcttagctccagtgttgctggagggtggaagtctacgaagtttagctacaccttcaagaattctccctgagtcacaagaatgtcagatcagatacagaggttaaaataaatagcattttaagggagcaagatggcctgagatggccttggtgggaaatctcagcttcccaacccccagaagcatgatgctctgagtcacacagtctttggggttttaacagagatgcaccaataccagtcaatatttattgtccaatcatatggacccagaactatgttcattatcatactcatagcatgggttgaatattccttatactcaaatgctccaaactggaagtttcaaatgttcacagatgttacaatatttatatattcataataataattttattttattacagtatttatgtttcatgtatacctttatacacatggcctaaaagttaaagataattttacacagtattttttaccccaccttggcttcaattaaatccaacccactaagtcagaggtggaattttccgctcatggtgtcgtgttaatgctaaggagtttcaggttttagatggggtttagatctgagatgtttgaccagtattttaaattagcacaaagatgcctttcagagtagaggatagaaagtctagtgattggcctatggtcaaatggcttctaagtggaaaagctgaggatctgaggtgtgtgtgtgtgtgtgtgtgtgtgtgtgtgtgtgtgtgtctgtctgtctgtctgtctgtctgtctgtgtctatgtctgtgcctgtgcctgtgcctgtgtctgtgtctgtgtctgtgtctgtggtattggctatggaacctaagaccttgtacattttaggcaagttctaactgctgagcccaagcccaagactgaaatctgaacacatatagtctgattacaagtccccatgtcctatgttaactgtgataactctagctttcccaagaccttttttgattgttcctggtgctctgttcaatttaatgatcacaatcaagaaaatgtcataaacaatgattttgcctcgataagtggtattttaaataatcagaatctgaatcattctgttttcaaaaggccctaagagctgggcactgtcgttgcttcacagtcaagggggttgaagcacactgttgtgtggtaacttcttcaaggtcacacaggaagggggcaacaaagaaaaagctgatctctgttgctcaggtccagaggccctgaccttaccctgctccatggctctcacagaaaaggctcacattgcaatgttagggttctcctgccctctgcctcagcctcctatacctcctgagcttgggtcttatctactctgtccccctttcttagactgtgtctccagttgttttcctaaactagtggttgatgctagctgatgacctagagtaatgctaaagaaatgagggtggggtgggccagggagggtgttgctttgcaatgctattaaagggagccctgtttcttcttaagactgattaactgcaggtttgcatttccaaatgtaattgtctttgaacatggctggaatctggaagggatggggtcttcattaggctggcagttgtgcacagattacttgagtttaatgtatttatagaaggtctgtgtgtcacacaggccttggggaatacttgcactatttaaaatataaattagaaaaatatgctgatgtaattgtctgccctgaggaattttcccctcatcacactgccttcatgccaatgtgaaaactcctacttggccagtctccccaggcagattggagtatgcaatgcaagttagtgagaaatgcttggtctgaacacaaatgctttgtagtctagggctcttcatggaatttatcatctcctgcttctcttctacctgggaacatctcttatctcctacctgctggtgtcagtggctttatgtgatagtctctgcttggacatcttcaatgtttgcttgtctctaactgcaaagctctataagtggtcttaacttctttcttcgtctacgtgaaaaaagggaaggaaaaaaaagaaaaagctacaacatctggtttgaagtggatgatcaataattattttgaaatacagggtgtgttgtgacagaaaagactatgattaaagggaaatcaatcctaaactgtttttttttttaaatgggtctcacacatgccatgtggtggtggctcatgcttttaatcccatctcttacgaggcagaggaaggtggatctcaaatgtggtaaattactgatatgaaatccataaaattaaggtaacttttaatagataaacgccagccaacagcaagccagagcgtgccaaagcagcaaggcgagacagcacccatgtgccttgtctgtccctttaaaacctctcccacatcagcttgaccacaccctgatgggcgtggtcgggcacacctgtagtcactcctttggaggcatgattatggtgtctccctacagatctttgtgagtttgagaccagcctggtctacagagcaagtcctaggacagccaaggctacgaagggagataaaccctgtcccccaaaacaaaacaaagcaaacaaacaaacaaaaagatgggtcttatatggtccaagctgactttgaatcactatgtatcactaaaaatgaccttgaacttcacatatgtgccactgcccctagtatatgaggtgttagagagccaacccaggaattcatacattctgggcaaacactctaccaactgagccacatttccagctcaagttaggttctggagaaatttttctagactctgtagttttctttttggggagtctggagtctgatggcaggctagtgattttcaaaataatggcagtgggaacctgttgagatgcaagtcaaaccatgattaagtttaaaccccagaaattgccggtgacttcacatccatttggtgatgcctatgtagcctcatgcccaaaaccaagctcatccaaaaccccatcctctccaacttcacctcctgctgtcacactcttcctcagtctgcccaaccaccctggctttctccatgctccttcaccaagcaaggcctacttctgcctcagggcctctgcacttcctgttgttggtctggaacagtggttcgcaaccttcctaatgctttgaccctttaatacagttcctcatgttgtggtgccccaaccataaaattattttagtttctacttcataactgtaattttctactgttatgaatcataatgtaaatatctgatatgtgaccctgtgaaatcattcgaccccaaagagttgaaatctacttttgagaaccactgatttagaatatcgtttaagatatgtatatacttcttcccccttttattcaatgttaccttctcaatgatgcattttctagctatcttacttcaaactacacacacacacacacacacacacacacacacacacacacacacannnnnnnnnnnnnnnnnnnnnggttttatccccctcaaccatattctttctcctaaaaccattattacttttccatatactacgaattttctctactttttcttcaaaggctctttaatggccatgttttccttttccatcttattctctattgtatcccttgcctagaccagtgcttggcatgcagtcagtcagccatattatacatttattgtactgatgaatgaaagccaccagttggtgacatgccagcctcctccggctctctgaaggaacatcccttgcatttatggccttccttttggctgtggtagtctctcagtcacattctctaatgagccaagcttgcactgcatttaaataaatgctttttcttgttttttgtgtctaagtattgttacccaattttattgttacaataataattgctgaaatagtgatagaaaaaaatcactaacatcttggaagtggcaaaaataaacaaattcaaagaaggccttacaggcataaagcaaaattatgtttattctattaaaactacaacattaattatttaaaatgtaattcctgggaagcccacccacctacccattatgctccaggctcaattctaagagctggagtcaccatgatgaattagtccctgtcttcttagagctatgttgttggataattaacaaacaaacacatggtccaggctgagataagctgaaagttaactcagtgtgttacacagagatgcaaagtggggccaataaaaatggctttgcttcatcctgatttaaggtcagagagttcaaaactatttttactcttccaaggttaaagtcataagacctaaaggtctaaggtgtagcttctataggatatttggtcttagtcgtggatatcttacctaactaacaagagacttggtctgaggtatggttactcttatatttttggttgtgagcctagcctttaacagctgagccatctctccagccgaggtacagttactcttaacctgcaaggccagataatgagagatttagtctaagacgtggttaccaaatgtttggagaattaaggaagaaagtctgtttcttccttatatcttgataaagaagtcttttgccattttcccctttttggttggggtatgtaagaatgttgaagaataaacttggcactttcaatatttgctggattgccctcctgactttatcctgtgtctctgactcttcttagtatctttacctgtggtttctcaatccacacctccccctctcaggtacaaaccaggcaaatcggctagattcaactggagcccctcatagatgggttactgcatgtaacccataaaatgggaaaatattttaagtattatgatcaggaaagaatgtgttagtcaggctttccatcagtgtgaaaaatacttgaagaaagcatgttaaagggagggaatttatctttccactcacagtttaacagatctcagcccattgtctttggtgagcctatggtgaaacagagtgtcatagtcgcaggagcaagtgggtgaagccgctcaccctgcagaagaaaggaaaatatagagaaaggagtcctgggccaggtacaaccttccaaggcatgctcagccaacacctctcccaaatatgtccttcctttcccaaaatagttccaacagcttgggacctagcatacagaagctcctgagtgacatctcaaaattaaaactataggagagagagtaggaagcattttagagaagtgtcccaaactaagaaagtcacataactacaatgacccccccccctttttttttttaaaggatcagtaagtataatgtccctgagatctgaaagtctggtgcaataccaactcccttcattctgggttactactgattgtgtgaagtcagcacaaaagttcaagcagattcatccatcttcagtgtagaagcaaggaacagctgtggaaatttgaatctcctgtctaccaaacagatgagtttggtgcctttcgaatgcagtctagaacttgcttcagaatcacctgggagcttgctgaaatgcaaattcttggccctcacttcagaactcctgagtcagatattttcaggacagacctcaaaatttgcatttaaacagctttccaagaggctcccatgcaaagatggttgaggtgtgtgctgaatggttttatgtcaagttgatacgagctaaaatcatgagaggagggagtctgtttcttcaattaagaaatacctccatggaccctgagaaaaacatgtatttctgggaaggggaaacagataaaatttcctgagttaaaaaaaaaaaagatttcctgagtaaattgggagggtgaaggaagggtaaaggggagaagtcaggggaacatgaggaaacggttgagttgggacagagagggagatcaaggaaagagataatctaggtagagggagccattatagggttagagagaaacctggtgccagggaaactcctaggaactcacaaggatgaccccagctaagactccaagcaatagcagagaaggtgcctgaactggccttcccctgtaatcactggtgactaccctaattgtcatcatagaaccttcacccagtaactgatggaagcagatgcagagttccacagctaagcactgggcagagctctgggagtccaggtgaagagagggaggagggattacatgagcaagggaggtcaaaatcatgatgaggaaaccagagacagctgacccaagctagtgggagctcatggtctctggactgacatctggggaacctgcataggaccaaactaggccctctgaatgtgggtgacagttctgtgacttgggcagtctgtagggcccttggcagtggaaccaggatttatccctggagcataactggctttttggaacccattccctatggagggataccttgctcaacttccatacagggggtgggaggggcttggtcctgccttaacttgatataccagactttgttgattccccatgggaggccttaccctttttgaggtgtggatagggcactgggtgggggaagatagagaggggaggggatgggaggaggggagggaggggaaactgtggttggtatgtaaattgaaaaaaatctttaaaagaaaagcctacataagactgggctgcaggcaagcctgtagagcattttcttaactagtgattgatgtgggagggtccaacctattgtgggtggtactatccctgggctgatggtcctaggttctataagaaagcaggttgagggagccagttagcagctctcctccgggcctctgcatcagctcctgtctctaggttcctactttgtatgagttcctgtccttgctgttaatataaagctgtgagtgaaataaaccctttcctccccaagttgctcttggtcatggtgtttcatcacagtaaccttaactaagacaaaagtgttggaataagggatctcagtattggggttgcctgtgctaggatggcaaagaaggaattctgaagtacagagattcaaggctggtttagcagggccccctcttccacttaagatactgctttctttttgttctttcttttagaaatgtctgaaatgcacaaatcatgcaaatacctgtacccactttagacagtaaaaaattaaaagaattaaagagattgatgatatctgtgggattagctggcctataggatgacccaaggcgcacacttttgcatctcacaccacagaatgtttttgttgttaatttgggtcctttgtcattctggaacatgataaactcctaacaatatatggaaacttgtttacattttttttcagaagagaggggcagtaattttcataaagtattcagaagagttcaagaagtttaagaaccataataaaaaaaaggtggttagctaactctgatcaaatgttaaacacattttgaaagccagggaaattggctttcttacccttaagcctccccacatccaaattctgactcagaattagctttgtgggtggcatttttctttgtatatagagtgtactcatttatgtcatagaacctcataaatagcaattttatccctgtcaggattgttttgacttaaatgaggtgggtagggttacaaattcccctggtctccctcctcctgacctgttatctctgagggtgacagctaacctttgattctccagtacccacacacacacacacacacacacacacacacacacacacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaatccctcctttgctgtctccccatttcacctggcatacagccaaccctgctatggccaaatgctatgacccacggggctctggatcatctattccctccttttcccctctcctgtcatcccttcagctctcctcttacctaatcaccatctcccacagaaccttggtgtggggatggctcacaactacccatgactctagctccagggaatgtgatgccttcttctgacctctgtgggtattcagatattcacacacacacacacacacacacacacacacacacacacaccagcaacaagccatcaattctttgtgatttaaaaaattagtcatatttttcttttgcttgagacattaattatttttctgttaaaacttagagagttcccgtgcaccccaaatgttcaaatgtatgctttgaacacatcactggcaaaaatgatgtcctcttagactgcacattctgtatccattctttattctttgctaaggaaatgggcgatatctcactatgtgagcagtggccacttacctgaaggcagctgttattgcccttgtggcttcccttgtcatgattaacagtccctactttcttaaactttttcatgccatgttgttttaagaaatctttccttgctggactagaaagatggatcagaagttaaaggcacttgccatcaagtctaaaaatccgagtgtgatccttggcactcacatagtggaaggagagagccggccccttccggttgtcctctgacctccacatgtgtcaagggccctcacccccaaatatagtcacagactgtaagtaaatgaaaatataacagaaatctttcctttggttttttgtttgtttgtatgtttgtttgttttcattgatactgtcccaaaatcgaaaccaaatggcacactctgagggggatttggaagaataaagaaagcagaattagtgatggagatgtagctagagcatttgactgcttagtatgtatgaggatctgggttcaatcaccaatgctgacattttacacacacataaacacacacacacaccacacacacacacacacacacacacacacacacacacgtgcatgcacgcgcgcgcgcgcgcgcacacacacacacacacaagagacagagagagacagaaagacagggagagagagagagagagagagagagagagagagagagaagcattatcagctctgctctttaagatgttaatacactagccaggtggctgtggtgtacaactttaatcccagcactcgggagacagaggcaggcagatctctggaagttccaggccagcctggtctacagagtaagttctagagaaaccctgtctcaataaaaaagatattaataacttggaaagtaaaaatacaagtttgaccttacattaactaaatccccagaatcttagccagtagggccactgtgaaagtcatatcacactacctaactggatgattgacacttggaccaaattgtccaagtcaggcaccaggccttgcatctgccactgccttttacagctttgtgtcagctctaggtttcatcaactgtcccttccttttcaccacttttctgtcacctgagcattccaaggcagaggggcctatgtgtctctgagcagatggtgacaatcactggcacttccactctggggtaacatccaaagccccgtgttctccaagagctagagagtcttgatttccttccctgaatccagttccacttccaggaattcttccctcacctcacctgcttctgtttggtcatcatctttctgtagtacataacattttcctctctggggggaggggggaaagacccagaacccagtggtaagccatgagatgttcacaccagctcacccagaccccagtgctctctgatggtgctctgccctcccctgagccctaagaaacacctccatgtttagtaatctctcttcccctggagacacagagggcactctgctttcggtatgcctggtacaattgctgcccattcatgaatagcactcaaagtaaagctttgttatctatggtgtcacacagctgcactgacctacagtcaccacaccatgtcttctggagccaaagaggatgctagaaagacagaactgtctggagaatgcatctttcttgcatggtgctctccgctagtgttgttacttgcaatcaaagaatcttggtcaccgcagacaaccaccaaccaaggaagagggaccagttctgtcatcctccagcacagaactctgaacatccaagctcttcttttcttctggagtcaggatgaagcagctgaatctcctcttggactaattctcaccctttctcctcacatgttacagctctggcctcagcagggaaaggataatttgaaaattacttggatgtgcattgaactgaatttatgagacaaaattacacagtgcaatctttgaggtttagtttcacattgacatgtgactcttgtgattaaaacacacacacacacacacacacacacacacacacacacacacgtctccgtgagaggtctgctgaagacatggcagaagccagctgtaaggaagaccgtagtgtcagccctcagccatcacagggacagccagactgaggagatgaggggtatcccactttctcttgtgttacaaccagatgttgtttctgtttataattatgtttttatttctgaccttattagcactgccaaaaacaatcacgggactccacactgatcaagttgtatccttcaactgtggtaggtcccagttgcttttcaagtttcactctgcactgaaagggtatctgtttgatcagtggatatccacatggcatgcccaattctcaagttaattaatgtctgttggcttcatccacccaacaatcatataaagacagaaaccatggactagtgagaaaaataggcaggcatggatgtaagactggggcggggtggggggagcagtgtatgtttgtatgtttacccatgagttcttaggggctggctacagcttcccctacacatgaggaaactcagacaaatcatttgcttccttttcagaaaacagaaaataatgacctcattgccaaacatgttactgtgtcaatcccatgtctttagttgcattttcacaatgtctacttatgaacaacattaggaacatagcaagcatcttctattcaacacatttttgactagtatgtggctgggactgagactggttctggggatacaaccatggaagtagcagcctgtggtcagcccagatcctccattgtcaaggctgcctgttgctttagatgtatattacacagcctttccactagaacaagtagaagccaggtgtgatggtgcatgtctgtacttctgaagcagtgggaatgtccaaagtttgaggtagatcttgggtacactgaacattccaggctagccaccaccacaacaaaagaactgaaatttgtcctccatggtgagattcaagacaccaagaaggatggagcgaacctgagtaaggtgcccacctgattgcaatcaactgcagaattttgtactgtaaggttctcattctagacctgagacataccaggaccgatccttacattacagggttcagttggtaacactggtcgtattgcttagcactgatggactgattagaactttgtgactatggagagttagagtgtcacagtttcagccaaactttggttatctttcatctccttaatagccatccattgcccacctctgtgtctgacctaacatcttgtgaatctcaggtaaaaccttctgggacatatgaacttagaagaccattagcatttataacaccgatccctgtgggcctataaggccatttgcattcaaaccaccagactaggtatctggctttaagggttcttggccttacagattgaataaggaacaccagggaaccttagcaatctataggcgatgaaggaaacatatattaacaagttttgggattgactccctaactgtaaagggcttttaaagcccagctttctattccttattagaagtttcaggagcaacagagaggctaccttaagtgctctctcctgataatgagattgatgactaattcatattacatcgtatagccttcatccaacagctggtggaagtagaagcagacacccacagctaaaccttgaactgaactggaatccagttgcagagaaggaggactgatgagcaaaggggtccacaccaggctggtgaaacccacagaaacagctgacctgaacaagggacagctcttggtccccagagtgatagctgggaaaccaacatgggactgatccagaccccctgaatgtgggtgtcagtgaggagaccttggaaatctatgggacctcttgtagtggatccatacttatccctagcataggaatggactttgggagcccattccacatggagggatactccctgagcctagacacaagggggttggcctaggccctatcccaaagaataagacagactttgaagacacctcctatggaaggcctcaccctcccttgggagcagaaagggtatgggataggtaaggtgttagttaggggggtcaggggaggaggagagaaaagggacttaggattgacatgtaaaataattttctttctaattaaaattaaaaaagaagtttcaggaaaacaaactttaaaggaatctcaataggtaatattgtaacaacatttatgaaagcagtcagatgaaatatgataagagtaggtctatttcatgaacaaattggggtttattgtgatttttttttgttagaaatgaaggtgtagcaagtccttctgtggacctgctatacagctacagctgggcctattgtagaacaatctttttgtacattgtgaatatgtgttgctgtcattggttttaaaaagagctaaataaatggtcaatatctaggtagaaaaggttaggtgggactttcggaaatgaagagtgtggggatgaagaaggtggagtcaccaggagactggggatggagggatgggagggagccagatccagaacaagttgaacacacaaaatgtgatagaggtaatcaagccatgaaacagaacacaaattaatagaaaggggtaaatttgagttataagagctagttagaaacaagcctatgctattggctgagcttttataattaataagaagtcttcatgtggttatatttgggaggtggttggtgggatagaaaagtctgcctacatggacccgtgttaccactgaaggcatggggatgcccatggtccgtgctgctacctgaagccatgttgatgtctgtgggccaggctgcctccagtgatcatgttggtgtccatggtccatactgccactgaaaaccatgctgatattcatggcatgtgttgacatcaaaggccaggtggatgtccatggtccatgctgtcaccagatactatgtagaagtcgatgatctgagctcttgccaactgtaaaagacacagaagcttctgtggtgtcagtaattacagactatcagctgagaaagagggacatagaaggcttctatggcaaccccctggcctcccccacccccaaaaagtaataccctagacaggaagccagtgaagagaactcttaaaacttgtcataaggatcctggagtgtagctctccataacagaggttactggtgagggtggggtggaaagaattcacttttctttaaggagctggacacaaggagtttgaccatgctccagttacaatacaaattgaactcttttttttaatcttttttttggggggggtagaaggccacaaggggttgggggaagcagacctgggaggactggaaagtaagggtgaacagggtgcattttgtgaaattcccaaacaatcaataaaaatattatgatgataataaaataataaatcttaagataaatttatacaaagaaagagaaatgaaggtggctgttaagtagaaagcatcagtctgtggaataccccttgtcagattctaacccacagctctacataaagtcttcgctccaaaggcttatgacatgggtgacttgataagaacttctgaggactacagttagtcctactgttgagcggcccattcagggtgttcacttcaggtgctgcaaacagacattcagattgcgatgtaggaaaacagcaagctcagacctagaaacctcgactaaccttcccctggacttgagagtgagcttctagtgtgtttctgtgtagtaatctttgtttttctcctggttatctcaccaagctcatctattgctgctcatgactaagccatatcctcaatattttggttttgtccctcagaaagtcattgttaaaatcttccttgtgtgatgtatttatctcagtattcttccaagtgtgttatcagtccttatctacttctaggtggtcttattatgactaacgtggcaaccggaagatcattaacacaggaaatctttcttcaaggagctccatcagcatcgtgagttgcaagcccatgatgagacagactgacccaaggttcaattagtctatcattaataaaaaacatgttggttatttaaataagaaaattgcttcaaacaaaacaactggagtgactgaaccaggccccctgaacatggatgtcaggagtcctgggcagtctatgggacctctggcagtggaaccagtatttatcccgagtgcacaaatggactttgggagcccattccacatagggagatactctctcagcctagatacatggtggagggcctctgtccttccccaaatgatgtgacagactttgatgataccccaagggaggcctcaccctccatagggagaggatggggagtgggatgggggattggtggggagttggtggggggcatgggaggacagaagggagagagaactgggattggcttgtaaaataagtttgtttttaatttaaataataatttataataataatttttaaaatagagtaaatgactgaattgctgaaatgcttgtcatgctagaatgaccacctgagttcatcctcagcacccatgtgacaaagtcactagggaggcagagacaaaaggacccctgagactctggctagctagtcttgttctatgtnnnnnnnnnnnnnnnnnnnnnacctgatgtcaacacacacacacacacacacacacacacacacacacacacacacacacacggaattaaaaaggcatttatttttccaagatggcctaagtgttttgtttctttttaagcaaagtggcctcaaatgtaaacagtgagaagaaacctgagcttaagtaagaagcagacagtcattcactcaccagggactgtatctccaaccacacccacacaggcaactcctcactgggtccagaacggtgaattattcaccgacatccaatcacagcctaatataagcccacagttcacacttcagagaggaccatcttttcccagtgttcatgcttcttatccagagttgtcctctgcgcagataaactctgcttagtttctgtaaacttttcatcttagtagctgtaactgcattgcaagtaccaataaagacacaccagcaagggcctcctgtaacagaagaggggacggattttaattggtcctccaagggtattcaagtaagactggatggagtgaggaagaggggaaggatgacagaaagtataccatgtgtgttggtgtgaaatggtggagaaagtgatcagagtgtgaaggaaccttcctgaaccttgagagcctgtgggtaaataaggcagggagttattgcctttggcagaggactatagaacctaggaacctggcaggcaagttcattattcatgtgacagtgaacgggaagcatagaaggtccttgaacaagggaggagctgaagattagcagttgtggtggtgagggggattgagcctgaaatttctgcttgagaagtgggcagtggagcccagagatgaggccttaagacaataaacaaaagccactgtctcacgatgattgattaaagacattctatcatttcagcaaggagaaatttggaaataacctcaaggtttctataataacagtgctacaattgaggtataattagacaggagggaatggagccattaagatgtaacctgaagtcttctttgttaatagctacaccacggggatacaactgaggattagggaatggagccaggttggctcaggcaagtgtgaggagccagcttcatgttggcatgttgaattttcctaggtgccatgtcagagtggaaatactgtttttaattttagctgaaatataaatcacaaattacatcttcatttcttagaaagatctgaactggtcaatacaaggatatattgtccttgcccttagccactccagttgggagtactcgacaagaaaacacattactgaggcactaatcagcctgtaacatgttagtgattcttggcatcttcacgctggaaagtgggagtctgcactacagatgacactagaaagcattcatagaaataatggacaggaaaatttgttgtcattcatcgccatgccaaccaagcttggggaaacaggcgttggtgactttctgaacttgtgcattttgaagaaccccaacagcatcttagacttgccattatcttttgcatcatagaactaagggtgtttatttctgtagtaaagaccacttacatatatgtaactaaatattctatgtgtatcgtcttattttccggaacaaagtagaaagcaaatctccaggtggtgaacaagattcagagtccttggagagcctttctttctcctctcatcttcaagctgctctgagaccctttcccctcccaggaaatgttcttgactatagggctgtaccggacccttaaagagctcacagcctggtggggaaatacatcaaaaagtcagctatgctgcagccttattctcgttttacaggacatcaagctatacgaataaaaattccaggaacctagttagcagagggagccatatcgaagaagtgatctttgaaccctgacttgaaagacaagggtacaagctcagccaaaggaagacagagcatcccttgcaaataaatgacaaacatggcttgaagactgtaagcgagacagataagtaaggaaagctgtgtggttgattggtggtgttggaggaggtgtggggcagctcagccaagtcatccagccaagataggacttaagcctgctgggcgccagtgcctgctcttggcctcgctccaaggcctgttggagcttgtaaaagaattcacattaatttgccttttttaggtatcttgaaaatcagtaacaaatagatttctcattttatgatggcagtgcggccctactgtgcaagggggcagctttgaatggcaaggagtctttgaagttagctcagccggagaagaaatggatttttctcaagaagccataccttgagaagctatacaatagaaaaacaaaacaggacaaaaacaggtgtaacatcacactgatgtactaaaacacaagaagggaattccagtgtgttgtaaggggacccagatagaaaatgcccagtgtttccaaagttgattatttgaacaagtaacttttgattttcactgtgtaagtcagtctctaaaatttggggtttactttgtgtttttacttctccacgagaatggctatcatttcagtagtagcttctgtgaaaatgacaactgtcttgtcagtaagaccatgacttgaagccattttggcatctttaatctacaggcaggatttatttgaaatattaatctgatgttttcacaagcaacattttcacatcaccaccccttctttctcttactgagagttgctttgaactcactatgtagcccgggattgccttgaactcacagaaatactcctttcctgtctcaccctcctgaatgctgggattacaggcacacccaccatgccagacttctctctctctctctctctctctctctctctctctctctctcttcctgtgtgtgtgtgaattcacatgtatgaatacatgaaactaagcatcctccttatccaaaggaaacaaaaccaacatctgggtcatgaggacccttataatgctagcacttgcgaggcagaagccagaggagtccagtgttgaggctagcctgaactacatgatgagaatctatctcaaacaaaacaaaatcagaagaatcctattcttcacaacaatatgtatgaatgaatttctaaaatagtatgcttaggaaatagaaagacaaatactgaaaaatcttacatatagaatctaaattatttgaaataaaaactgtagaagcagaaatttcaaggagctggggagcaaggagggatcttagttaaagggtgcaagctcccaggtgtgaggtatgtgggttgtgtggcccctgacagcacggtgactacagctaagctgcagatgtgatacaatctggaagtgggtagaccttcaagttctcaccctgttgtcccatgtgaggcatccgggggcaagcgttgcagctaactcagaaatcaccatacaatgtgtacacgtatcaaataatttcaacattatcttcagtttatacagcttcattagttgcaccattagaagctaagtgagaaatcttttgaagtgaaaatttaagagccaagcttccttttcgggcaacttgattggaatcttgagatgtttgctttcccactgatcctaatcaagaagctgtcctttgccagatcagttacacaggactggcaggcagggctggaagctttagaagtctctttaagcagaaaaactcatctgtagtgtcacaggccagagccatctacgtgacttctaagcttaaccgtgtcttttcctacaccattggtctttctattttccctttctcaatttttaactttgttctttattatttcttaaaaaacgagtttgtgtgtgtagcttatggtcttgccacctgaaaagtttgttttaacccaagtttgtcctcaaaactttgttttagatcttttgactgcaattctttcatttagtgatagaacgaggtattagattttttttcaaaggatttgccgaggttcaaggttttcacacaggcatgaattcacagttctgcagctgtccaagcaatgctgcataggagttaaactcacagggtcagctgtgtgcattcttggtagctacgaaaaccttttgtatttcatttcttcatggttagtatgagtttgatgtgaaaaataaattaataaatccatgtgtagcccttgggataatcatgtactgttttgttgtcatttctaatgcgcctttcacagaagcaaaggtttgtcaagcatcacagctgcttttgacttctgaatgttccactttgccatggagagagggggagggaagaggagagagagagagagagagagagagagagagagagagagagagaggggtgttctccccacatgtgtgtgatattccccatcaagggcaggggagggagtctcacaaattgcagtcccattttcaagcagcattcaaaaagttgctgaactccagcttggcctccataacaacttggctttgtgtctccttggatagtatgaaccagattttcaaaaattcttctcttgtagtcttgcttaggatgagtcacaaggaagatggcagatggaatgatctgccattcaagaattggcagacatagtcactgatctgctgatgtgccttgttggccagagacagcagctggacctaaagacactctatgtcctccagacagagatgtgtgcatgtggctccaggccaaatggtcaggcttctggaggacacattacccaccaagaatgcacataggtttcactccaacaattcatttgaaatccctatatatgattctgtgtgtgtgtgtgtgtgtgtgtgtgtgtgtgtgtgtgagtgtgtgtgactcacctatgtgagtatatatagatatcaaaagtcatcttctgctgtcttatatgtgggtgctaaactcaggtcctcatgcttgcaaggctagcaaccgactcactgtgccatctcaccagcccacgtcatgcattttcaatgaccataaagtttcttttagtcatgtaccatgtttaaatcaagaacctaaagagagcaatcaccttgcttttagtgatggcacagcagcaaacacttttatgcatcggtccttccagggttctctgattattctcttaagacaggctcccagaagagagactgtttaatcaaatgctaagcacaattacatttcggttcactttatcagaatagttgctctaatttactcttttactggctaaggatgaaaagacctgattcctcagaacttccttgaagttttaaaccagggcatctcccactggacttcagctttgatgaactgagttgggattttgtttctcaagatctgttatagccaaagggcgtctcttaagccagggggctgctttgcttcaactaatcttagtcacacacatctcaactctttgggccaggaatgaaagttccaatttccctgcttccctccaggtgtctctcttgggaatatctctgagacttcaaaaaaggggtcaaggtgaggaagtcctagaagcagctgagaaaacgtgctgaaccagcttgcttgaggaacctgctgaagccttcaccttgcgctcaactccagagcgcctgtagatctctgtcagcaagctcctctctgcctgagaaaggataggcttcacaagttctctacgcgtccacagccctcacgctgaactcatgagtgcacttgaaacacctttcatagggagctaaagaaaaagctggggtgtgtggggggggcgtgagttagcggctcagctgatccacacacatttatattttcatcctgtttaaaagggttctctcactatgcaggctttgagggggtcccagtatgacaaagtccatttcaattacagatcgcaaataaccattaaaatcatatccctgccaagctctcattttctaatgtaaatccactcccctctttttaaaagacagctgggaaactcatcttcctccaaggagagcaggtaaaatggcttcagtccacagccaatgactccgtctaccctaggttcttggctcaggtaaggagactacctcctttttataacaggatattcacatacatgggaacctcatgtgggcggcaaccaaacttcatttctctactacatttcccagaatcctctttgactcctagtcctgtctaacttgctgtctcattggccaaacaatattttatttaacaatcaataagataaacatacacagtacattccccatcacatgtgcttcaggagtctttgtaaatgaagtttatctcaaaggtttgttaagtgtttggctctgagtgggttttgaacggtaggtgactgcctaattaatgaacgaattgtgtatctaacagtgtggttcggatgtgtgatggcatggttgaaactgtgtgacagtgtggttggggtgtgttctggtgtgtggttgggtgtgtgatggcctggttgggtgtgttctgatgtggatgggtgtgttctggtgtggctggggtgtgttctggtgtggttggggtgtgttctggtgtggttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtggggtgtgttctggtgtggttggtgtgttctggtgtggttggggtgtgttctggtgtggctggagtgtgttctggtgtggctagggtatgtggtggtgtggctgggtgagttctggtgtggttgggtgtgttctggtgtggttggggtgtgttctggtgtggttgggtgtgttctggtgtagatgggtgtgttctggtgtggttggggtgtgttctggtgtggttggggtgtgttctggtgtggctggggtgtgtggtggcatggctggggtgtatgaaaagtacctcttcctactaacaaggaagcctctttctccttagcatcacttgaaacacttttacagttttgttacaaatttctgaggcctagaaccccagttacctggaagtgctgtttcttactaatagctttcttacccagcaggcagagctgctataagctatggcaggctgaggagagagggattctgttttcataagggaagaggctctttccttttcaggtatggtgtgacaagcagctctggagataaagtcacatctctgtcacactgcccttctgtcctggatgttaacctgtattacggtttgtgtccaaggcttgttgctcagagttgtggggaggtggtggcacttttaagaggtgagccttgtatggtcatctggactggaacattcccattagagggtcatctggactggaacattcccattagagggctagtgtagccctaacctcactctgttttcattcatgtcctgtccatggagtgactgacttgcttcactagtgtttcatgaagtgctgcctcactacagccccaaaagcagtggggcaaataaatgactatggactgagacctccaacgctgtgagtcctttccactttgcaagttgacttatctcaggcatttgtgatagtaacagaaagctgactaactcaaaagataacaattagtgaaacttttggggtctggggcaggtaacgttttaaagggaggtgtggtgagaagaaaatgggctaaaggctttcgtttcatatactttgtggtctaggcttagtctcaggagagcagttcacaatgactagtcaatattacttggtactaattatattagacacatttcagaaggcagcctgcttgaagcctatcattttattagcaaggaaagtccgaactctgacatgtctctcatctgtatctttgccagatctattcactaaatttatctgcacatactcaccccacatacacatagtcatacacataattaaaagtaaagtaggtcttctaaaaatgcaaatgattttggtagagagtttggatatcctacctctgaaatgtctgggaccagaagtgttttagatcctggaacatttgatagtgaactgtttgggggatgggacccccagtctacacacaaaacccacttatgcttcatgaagattgtctgaaggtaatttcttttaatattttttggtaggtctatggtctgactgtgacctagttagatgaggtaaactctggaattttccacttagggtatcatatcagcactcagaaagatttggaatttggaacattttagatttcagatttttggattagtgacactcaacttcttttaaccttgatcccatgactttggtaattttacttattgtaaattgtttagaaagttctaaaacatttgtgttacctgtaaaaatcttcattgctcctttactgatttaaaattttctttttattttattttattgccacagccaagatgtccagtccaatacaacactgaaggtaagtgacagtgagtgtagcccacagggcatagtgcaggctctgcacgcccaagatcacatactcttaaggaacagcaggctttgactagctggtgcaggtatcagttgaaactacaagtgttagagaaatgtcaaactgatttacctactctgcaagagagaactgtcatagttgaggggaggatgcatccctaagatgatgcccagggacaaaacaccaggtgggaagcccagagggagaagaagaagaagcaatcctcctccctcctcggcttccattcctcctttagcaatggggtctatgacaggatcactctatagaggagagatgtggtttgcaaatcatagacccagcatcacaaaactgaatacagaggataaattcagtccaggggccgcagattaataacgatcgctccagaagttcacatatcaacgtcagagaccatggcatgaccctgagcaactcccaaaaagtccacagaacttcacctctgctttgttttactttcatggcatgggaaagaccatcaagctcagggtaacacaggttcactctgctctgagctctgccccacattgaggccctgggaactcagctctggggaagcctcttgacagtgtcacttctaccatcttatgccatcatagcctttgtccttatttctcccacattctccgaattgctgtcactttcctccacaaaagtactttactcttgatcctgagagaactccattcttagcaccccctgttttaggagtctgcttccttccagggtaccatgagcatggtgacctcacctctctctccctcttacaacgtcatgcacacattcacaaacacacaggcaagtgtgcacagacctggcaacctcagctcagaaacccaggacggaagcagagttagcatccaactttttccttggctgattctgaagttcttgttctttgtgtctgccctgaacactacaattctttagtcttcaacactaagaatcaaaaactccaccttatatcccttcatttttaatttgcttttaaatatcttgtcgtatgtgacaatcaaattcctgtttaaaatgtaggatggtttatattattttctgtatgttataagaggaaactttggctcagatcctttcctaacagagaggaaagcaagtccaaaggaaacacagatggttgatgaacccacctctgtttcagtgtgttttccatctgagctcactttaaacattttgagattaactctataccccaaactcccccagtctcttttccttcctctgcctggaagccatcgggcactgtttgttcttttagagatggctggctttcttagaagttagtttctagttcctggaatatttaccagcacatttgcctcttattccaattttttcctgctttttttttttgagtgctatggtctgagtacttgtgtcccctcaaaaccaatatgttgagagatgaccaggtcatgaagcctgtactcccatgggctggagtacaggcttatgaaggaggattgaaggagcctgttacctcaccaccaccttgtgagtgctcctgtagaaggtgagtgttcctgtagaaggtgagtgctcctgtagaaggtgagtgttcctatagaaggtgagtgctcctgtagaaggtgagtgctcctgtagaaggtgagtgctcctctagaaggtgagtgctcctatagaaggtgagtgctcctgtagcaggtgccttttgttagcacagagcaagccctttcacacattgactcagctgtgcctccatcctggtcctctcagcctccagaactgtgagcaatacacttgtagtttttacaaagcaaccacactatattgtgtattgatatcccacatgagccaaggtatgtggcaatctcttgaacatctacctttttgtttcgatgtggtgagagagacaaacatcaaaaggcctgcgcttacttcactgtgtgagccttagtttgcagagccaggagaacgtagctatttgtctacagatttcataggtgctgcatcagtgctgcaagcgtttgtagctccatgtccctccagatcgccctctggggagtgaagtatttaatctgctgggccactatatctcaagtcttgaagtagaattggcatcaacatcagaactccttagctagattcaattgatcctttcttggtccctttgttattattggttttcaagaggaggtctctgacccagacattcctcagactcactatgtagaccaagtcagccttgaactcctgatcctcctgcctccatctcccaagtcccatcattttagacacgcactatcatgactggctcatatgtgccagtgaaagctagaggccaatctagatgcgattcaccttgttttagaggtggagtctttcaccaaacccagagttcactgattaggctggactgactggccagagagcttagggatccacctgttctttcttgcccagcactggggctagaggtgtgccccacatcaggcagacaggaaaggcaagtcaatacgcaaacagatgctggagacacagcaagcatggaattccagcagagcaatgctatccttccattttcccattgacaaaaatgggtgagaaagcctgggtgatgatggcacagtcggtaaagtctttctatgtgagtgtaaggactccggttgagattctcaagcataaaggcttggagtggtggtgtgcacttgtaataccagcactagggaggcagagaaaggaggataccttggattactggacagtctagccaaatcagaagcgtcctgtctcaaaaattaaggcgtggagtgattaaagaagacacttaacattgacatctgacctccacatacacacataccccgtatattgtacacacacacaccaaagggtgggtgagattgcattattttctcatcagaggctgtgattacatgacttcataggctatgctgcatcttgtggctttctgttctggttctatgagcatcaggagttccaggggaatgtattgataacaaagtccttagaaatgtctctggcaaaataattcaaaattgacttgggatgatgaaggcatatgtgtagcaagctttcttgttggactatctttgacttgctagcccccaaataacaacatggagacttattaattatgaaagcttagcctttagcttaggcttgtcccaactagctcttacactttaaattaacctgcttttattaatttatgttctgtcacgtggctttgttatctccactccaataccatatatctgtgtctccctagcataaactgtgtacctagattccttttcctcttcctctctctccccagaaactctacccatcctcttctattggccattcaaccctttattaaatcaatcagaaggtgccttggccaagacatatcttcacagtgtacacagtgccccaggagagcgggtgctgggtctggccagaacctgacatctctatgatgatctggaagagggagccaatggctcgttaatagagtctgaaaatgaggtaaaatgattgatggtgttctgggaaacaaagggattagtaaagctagaggcaacttatggaaatgctcactcatccttggatcagaaagtcaccatctgaagtcgtttaatggaagtgatcagtccagaaagcaccttgggtaccagcaaatgcctggagacaatgccaggaagagatggggagctgagccagcacaattggaatttctctctggaaggatctggcaacatctggccagggttcatgagttttcctcagctcttgatacacatccagggaccctgaagtccattctgttctgcctgattgccagcttggcctcacacttcttgctggctgagaaagatgccccagatgggtttctcatcatttcaaaccagtcaagtaggtgctgtttaatactttgtcccctggaggccaataacaaggccaaggctaaagacatgggtctgtctcccatgcagaatgctggagaatgttccagcttgaattggaagtggttatgtgtaaggataagtctttctgccaagccacccaagcccggctgccacgtgggcgccagaaacaacacacagagtctgatattaattacaatgctgctggccaatgactagggtttcttatctgatatctaagtcttaagtatcaaccataattgttaatctatatattttataaagacttatctgatcaaggatgctggtggcattcatcctctcttgtggggatcacatggcagctcccagagaagagaggaggagggagaggaagagcatgatttcctgcttgttcctgcttatattctgagtcgcctgctatgtcacttcctgcctgaatcacaagacttctttttactacatttcccagaatccttctcgactcctagtcccacttatcttgcttccctattggccaacagtactttgtttaacaaccaataagacaaggacttcctctatcagttaagtctttggcttctactgtcatcctaacccaggtgtgctctatttttagtcttgtaccaagggtaatactgcttgccactacagagtttagccgccaggcttgctggatggatacagtaccctgagtgtttcccctggcatctgcatgcctcccttccagtacccttttatctcctgaagcattgggaaagactgaagaatttaaggtatttaagtgtcaactagaatccagccctgacttcagaaggccagggtcaaacatatgtttctccagacttaggagtctaactgtcccctgaaggttgagacaaattccttctctcctttcttctccccatatttttgttgttgttgtctttcctcctgttgttttaagatgaggcttcaggtagctcagactggcttctaaatcattatgtaactgaagctggtcttgaactcctaaccttcctgtttcttcctccctctgagattacaggcatttgctattttcttccctgtcttgactgttagcttaatcaaaccttgtaacttctgagagggagacagaaatcgtcttttgtggtgacagtcttacctgcaatcaggaagtcatggccagcttctcactgtagcatagcatcatgtatattacattaaaatttttaacccagaaaaagcacaattgcttcttatgagagcctggagtcgactcagcaatgctatctaactctactgtcttgggctattaataaagttgaatttatgctgattcagcatttggaagaattatggataacaggatgaacttgcaagtaaatggttgcatgattactagattaacggagaagaaggaaagggtgggtaggatatgccaaatgacagtgtccagcacacgatggataggattcactcttcagactggggttcactggtgtctgcgccacactagcttggaaagccaagatactggagacccccacatcccttttctttaagctccatgtacacttggtacaagatacacttccttcttgctctgtaatatggaaatatccactttcagtagcagtcctctgagagccatgcttggccatgcccagaatggactgtagcttctgacctgaactcagggaatcatggaaaagattctgtagattctcagaccctggtcagatctgtcccttgtcagacgtcaactggatgcttgctcagcattcaacagcaaacagctgacagttctgaaccctgtatccttcagctctgcccttcccaacgtgcagcctccacctgctcactggttccttgtagccaatgcatcagtggctgctacgattacatttcatgtcaccctcaattaacctgacaggatacagccctccctaccccctccagacactaagaggagagaagaggcttaaggtagaaaacagaaagaacttttatgttcttggctcttctgcaggtaaatctctcagaaaattgcacatttattctttccaggctctgagctcacactgcagcagcccagatctggaagtacctgtcaatttatccatcagctttcacagggtggaaacccctgtgagactggggccactcggcatactggggatgctaatgacagggtcacagcaaacgcctgtctttgtgcctggtgggtacctcccatttcatctttcagataaaaatagcacagaacttgattgtagaagaaataaaaagtgtgtgtgtgtgtgtgtgtgtgtgtgtgtgtgtgtgtgtgtgtgttgtgtctccacaggatagtgtcagagccaaatgcctgtgaaattttccaaggaaagtgaaaacatagttgctgtcaacctctttcagggaatccatttttcccctctctgaaattggactgaatacaatgcagaggcattgcagtctgtaccaaagctgtggctgttggatatttctccatatgcaaatggagcttatgacatagttactcacattatctatacaacacacaagcagcatttattacccagaaagcaacattgacaattaaactgaaagttggggaagaaacctagctagctacttaatctcttttcaatgctggaatatgccaagtatattttattaaaattaatggattataggctattatttcactgttatatcaatcattgaaggcccaagatatatcactgacaaattagcaaatacaaatgcaccagttgttctgtggtatacacctttaattccagggttcaggaagcagaggaaggtggatctctaagttagaggccagcctggtctacagagtgagttccaggccaatgggagctacatagtgagaccctatctcaaagaaacaacacaacacaacaaagagggacacccaatgtggcaattagctttagttaccaacttgactctgatgagtagacgtgctgacacttcccctaggcagggagtcctgaactatatggaagtagagagagcaagtcaaatgagcgtgcgttcatcattccctgctttcgactgtggatatgataagactaattgtttgacatttcttccttgacttccacagaattatatctgaaataaacccatttcttacctagattcctttttgtcagggtattttatcatcagagaagcaaaaaatggctctaggacaaccagttaatattgattttcagataaacagcacatattgcttggactataattataccaaatattactaaattttaaatttagctggctatatagtttatttggcaattttacaaaaacacctactttcaagctaggtacagtgggctatacctgtaatcctcgtttcttgggaggctgaagtggtaggattccttgagcccgggagtttgggctcaataacatagtaataagccattcatcagctcagaaaaaaagaaggagaaggaggagaagaaaagagaaattaagaaaaaaaaagaaaagtaagaataccaagatatctactcaagagaagcatgagggtggagagatctgttttggttcagtgtcagaagggtcagtcagtcctggaatggctctagacacatgcacagaacctgtacaccagagaagattcttcatcgtttggtgaccagggaacagagagccagaaagagactggggaccaggaattacctgcaaagtcatctctcaggtgacctacttccaactaaacctatctcctaaagattctagaacctcccaatagcaccaccagctgggacccaaaccttccacatttgaacctgtgaggaacaggtcacattcaagacagaaatgctccaaatgtgtattccttcagtcctcatcctcattatggtttccttgtttataacccatggctcctgtagttgatgtcaccaccctaatgtctgccaaagtgcatgttaggaaaactctgaggaagccgggaagtgatttgctgcagctgttcttctgattgtcgaagtcctgggcttcactgtgtctgtgatcagtatacccctgatgtttgcttccgggtcttctttgccacactcatttcttcatcattttgaagtataaatacgaacacagggtggaactatacaaacaattggagaagatactggagtccgagaaagtgtggaggagggagatagggaagtatggctgttaatattccatggcatgagtatctctagcacagtcacacccgtggttggccacaattagttgactgtttcaaagtagctggtagggagggtttgaatgtttccaacacaacagcttgatgaatgtcgcggatgattattttttatgacctgatcactctatttgtgtatgtgtagacagaccacactgaacccctttgagctgtataattaccaggtgccaattcaaaggaaagctgcataaaatttccatgagaaggaaaataagaacctcaaggtgatatttaaagtttacaatattactctggctgctttgcttttagcaagctagttccaggcaagcgatgctctatttaaagcaggggtgagtgagcatcttgaatgggaattttaaagggttgtctcacctttgttgagaaactttctgaaacagagcgtggaagtacatgcctgaaatcccagcactcaagagccagaggaaagagaatgctaggctgtgagttcagtgttagcctgggctacgtaatgtgttccagatctgccagggctacatagcaaaaaaacagcaaaacattttctaaggaatctcattgtaagaaattaatatttttagctttccactaacaagaaaaggaaaaatagatttttgactagtaaaagttttatctttttttgatgcggcattgctgtgtttactaagtaaccaagacaatatagaacagattctttagattcaagttggccttgagatggtcaagtaggatgatgggacatcatagcaagagcaatgccttccagatgatgtcaggaggactggaaacatccaggtcctggatgaaagggctcagtggcttccggagtggcccctgctccctggtgggctacctctggactgtgaaccttgctgcttgctctcctcctccagtctctgtgtcactgcctcttgtcaagtgctcatgatggcacaggagccttccacctgatacccactgcctgcttttcccatgaccaagttagctttcatgacacatttgaaatgccccagaggggacagctgttagagtctacacattgcctgttgctgttaggttggtaactcacagagggctcattcagacacaccatactgtgggaaaatgcctcagtaagtaaagcactcttggccatggccttcggaatacttttcagccagatccaattttaagtataagtccatgtacgctgtgtcttcttgtcactaggtcaagagctgacattcatttgttcatttgcctcatcgttcctagttaattttcatgttccctcacccattggaaaaagcgtattgagtcacaatggcaatatgcaattctattattatttctggggtcacatttgagattcaagaccttggagtcattatctgctttttttccttttcactgggaagtttctcctccagaaagttttatcatattttttaactatcttccaaaattggctcaaagtgctggtcgccataaaaaaaatattctgtgggaaatagggatagactacagcttttgattacagttgactgaaagtcaagagaccctggattttgtaataaaattatcacccagagattcttttctcctgggttaaaattgtctaccccagatagtgtccctgtagcaatagcttataaggggaagaactgcaagggtggttctctatgggctttgcattctgaggcaagggttccttgtggtgaaaacttccataactcagtccagtaaaaatgtctctttcctcacttaggaagtattaggtgaaattattgacaaacttcatgtttttataggtgaaaactagcaaaatatcttccattttccactggccaagtgattgtttttcagttacatattttcaatgcacgcatctgtgcatgtgcaccgtgtgtgtgcgcgcgatgggtaaacctaaggttaaccttggatgggtgtctttcctccaaatccatcttccaccttggatgacttttttttttttttacaaagtctctcattggtgttctggggctgacataccaggttatgctggctgaccactgaggccaggaagctccatcctctgcctcctgagcacggtggttacaagggtgcattgccttgctttgctttttacacaggtggtagaggatcaaactcacacccatatatgtagcagcaagccttttctgcctgacctatcttcccaactcaaatgtgcccatcttaatagcacagtttcgtgtgtgtgtgtgtgtgtgtgtgtgtgtgtgtgtgtgtaagcatgtaaaaaagacgacaacacacatacacacacacatacacacacacacacacacacgtatgtacccacacatgtatgtaccagtgaagacacaaatgtaatcttctgacaaactttagtttctcagacaaccagctactgtagaccaattgtgtcttctctaaaattcagtgtaacttgtgtgatggagtatataaccttggtgtctggcttctcacccagaaaggcctgtttcttcatccacagcatggcagtcagcagcttgtcttactgttacagcttataactgtcagtttctttacccactaacctattggtagatatttgcactgtttccacttggggctgattatgaaactgctttggataaatatttgcattcagatctgtttgtgatgtattcatttcacatggatgaatagggatggagtgttggaccacatctaacttactaagaagctgctatctccctatatgtttatttctatgctattctgttcccctggcatatatatttaactttgtgggtacaaatttagaaaccatttatgatgttctgaatttaagtatcagaagtcttgtagctttgccacttttttctggcttttgtgctcttcataactctagaatgaggggctggagaaggaggcttagcagttagtagtgtctggtaaaggaagtgatttggttcttagcacctgtgttgagctcttcatggccacctataactccagctccaggggagccaacgccctcttggacctctgtgagcacctgcactcgtatgcatatgcccaccaactgcaaataaaatagatctttgaaatacatacataattaattttaatatattttacttgcaacagttaggactatgtgcatgttattggtctgtttctttttagtaaaatgtctttgatggggtaatagcccaattctgtactttacagagaaaagtgcatcttccttttcagttttctgaaggagtttctactgttgccactaagacttccataaatatttgatggcattcattatgagaatctgctgtgactggagttctctttgtagggatttttttaattatttcactaccttaatctattcaatttatttcaatctacttcattgatttttaactctcaccttcatttctttccatctccccaaccagggcttaatttacttgtggatttgctgggaaggttctgaagggaagctgacagaaacagtgtgatcctcactgtggtgatttcttaaggtgagggtcaatgcaggtaagagtagcatggtaccccaagactagaactatacaatggatggagggtgcgtctcagaggtccccttctgcccattctttgcctttcagaaatgttgactacaaaagcaatcttacctcagatctatactcctgttacacctactagataatttcatcatctcagataagaacctggagacagcattgaagctggctttgctgctgctcttgccacacagtgactgatgagagtgctaaatctctgctgtgtccacacttggcaagtacagctggcatgaagactagaaacaggaggatggaagggtgttaggatgcttccaacccacatccccagctaaggtccccaatcaagaacatctctaccagagtctacggtagagatgtggagattcagacaccacctcctttggcttacttaaggtgatccttaagtgttagcaatggcgtggactgccttggtcagcttgtaggagtttaaaacttcccaatcatctggtgctactggtttagttgtgcaggtagctcctgcaactttggtcaaattaaatggtatgtttctgactgctttgccaatttcatcatccccacagcatccataaaaactaggtacagcttccgatgattgttctgttcacattggtagttcctgtacatgtaacagtgaagcgtggttcacagagaacgtaggaatttgaggttcccaccattaccccatagttataagtcagctttctatgtaaccagcaagtgaaggcttggtatccatgtggcaaacagtgtcctgagggtctagttgcagctgaagacaaaggtgtcatctatgccattttccattgtctatcaatcacctgagaagggacagattcttggtgatgttgaaaatctttatgaagaaaaggagtgtagaaagaacagtactaatatttgctatcgctcatgtggtaatcactagcactgaagggcagcactgtaattactgtagatgtagtttgtggttttgtgtgtgacttaggcttcacatgaaaggaggagttgagctaacaaatgacggggtgtctgagggctgttagagctgcctattctttgagtctaggcaggtggatgaagcagcagagttnnnnnnnnnnnnnnnnnnnnnnnnnnnagagagagagagagagagagagagagagagagagagagagagagaatgtgtgtgttttctcacagtaactaatggtgattcattgtgtttgttttcgttttttgtttgagatagggtttctctgtgtagccctggctgtcctggaactcactctgtagaccgtctggccttgaactgcctgtctctgcttctcaagtgctgacattatagatttgtaccaccactgcctggcttactaatggtgattcttataaatataaaagaaaaaagtaaaagttacatatttttaatttgcaaagctattaactttctttccctttattctaaagctatctcaaaatatctgtgtatgagggaagtttccaccaattctagccctggcttagaaaccagatcttctgtttctagcttcagttcatgcaaaaatagacagagtgggaacaatggcctatgggtttcccagaggttgtcacaaaggattgaaaaggtggttttcaattctccatcttctattgccaactggactcatgccaagttctagaaacacaagcctaccccagtaaataacctgtgtcgtgctgtatgttttctgttgtcctgttctactcaaattagtcaaaggcagatccttccttgtgctcaacattgtggagccatactttggcatccgaggagcctgttactatgtatggtcaggttgactgaggtcaaagagactacaatgttgagttcccagttggtagcaatctaaattcttggggaatgctagtcttttctctcagggtgagggtaaattctcttgcttaaaagcttcctcttcctttcttagatgacttacatttgtaaaaacatgttcttagcagagggccacagggctagagaatctgtcagatgagcgatctgaggagaaaggaagagggtcttggaaaaaactcaaagcagaggaactggcatctagcaggaagaacatactcaaaagagaattaggctaacagctaaaaatgacaaaggttcagtgaatcacaaaaaggtcacaagtttttcttcattttccaatagctttgggaaaaaaaaataccctttaatgaaactatttggatgtcagaatttgggttagacatttcttcttgttaattaaaaaaaggtaggatatccaataactagaaattatcatgattcttcactccaaattatctataaaatgaacaatgtaagttacatcgagcgttcaacagaacggccactagcattccaaattatcttgggtgaacttgtataactttgtaagatatgcataagaactcaaatcagatgaagatatctgacaaggagccattgataaagtctgaggcagcctttgagaacttacaaagatctgatacaaatgtctattgtaaagctacaagccctccaagcagaatccagtcattgctgacaacagaacttataaataattggcctttagtcaatgaaaattttggaaacctatcagagagaaaaaggaaaaaaatagaacatataatatttctagatggtcactgaggcacaatttatctgttgggagatattagtctgacaaggtcttaaaattttcagttaccagggcctagattgaaagtattggctgttgttcacaacattaattcatgtccagcctaaccaggtgtgtctatcctatggcccacgggttacatgcatcccagggtagtgatgtgtttgtagatgacaatttcatgttgcagtgtcaaaaagttggctaccccaaaccaaagagttttgttagagtccccatgtggttttccagtgatgtctgcatccatgtaagctgtgtctgaggataaggctagaggtactgagactgtggtctacacacccctataagctgttatctgagggtaaggctgtacatcatgtaaactgggtctgaacattggactggaagtgctaagcctatgaatttgttacactctgttctacacagcattgcacgtgacttccatttgtagatactattggttaaaaagtgatgtgtgtgtgtgtgagagagagagagagacagacagacagacacacacagagagagagagagagagagaaagagagagagggagagagagagagagggagagagagagagagagtctcctctaagcaccttgcaggaactacctaagtttgttctcacgtcacacacttaccaaggccatccaggtaggaaaggcaaccctgaattcagtcccggcagttgatgggcttcacctctgtcttccagacagtggaagtttcaagggttgtgaggggctggtggctgtgagtgtacactgcatggcggttgttaaagcaccaaaatacttccgtaaactgaccaacgtgagcatcgattctatctccctaaagataaagagttaatgccaactccagctggaaacttctagaaaccaagtcaagaaccaaatgttgcacctctgtccatgggtccttggtgtgggatttcccccgaggatttctggggcatgcatcctgggtgtggttttattcactttcatccagaaacctagaagattctataaatgtaatacttcctacttttttaagctctgaagagaagtgtggtatatatatatatattctaataggattaaatagtgaatttcacttcctgcctccaggagatgctacacagcttttctgaaaccttgccttctatacatctgtgaatatacccaaacatgaattcataccgtcaattaacaattaacctggcttgctagtggatgcnnnnnnnnnngtggggcacatggaaataacactggtggtttaagcttatatatatataaaacagcttaccacagctatcaagtttaaaagcagaaagctacctgcaaagctgtagttccgactataaatcagctgtattggttaaaagttaacatttttattgtcttatgagacttgtatttagcatgttttaccaagctcattcatagttgcttcatgattgcctttcattcatcattggaggtaaaagaccaggtcttatcttcaaaatgccttcactgttttattagggagttctttttaaaaggcacgtcaagaaaaatggggtctttgtgggtgtcagttaacccttttggctcatgtgtctttcattcttaaaaaaaaaaaatagggagggtattttgagaaacagatgacatctctgcataatgtatgtatagcccaacaactaattcccaagttgttctctccctagatattgtcaaaacaaaagacaaaattaaaaggtctttattttgtgactccagaatggaaaccacttcagtccataaaaggtagtattttatgggccgagcaagagagatggtttcacaaagaaacagaaaaataaaagcagactgaccttnnnnnnnnnntgggaagtttagttatttctcttaaccaatttcatgaaagattgtgtgacagctcagggtttgtgaccggagctttggcaccaatgactctagtttgacttttgtctggtcattaggtcactgggagtgtgtcctaagagagcactgtggaaccctggttgattccttattctctccttgcttctcagaacacagtaaggaggtttgctttaccatatgttcctgccatgatgtaccatcgtcatctcaaacatggtccatcaacatctgactcagttctctaaaactgagagccaagatgaacctctgattcataagcgatcattatagacagttttattttttacagtaatacaaagatggtttaagttcaccacaatgcacaaggtaaatcacaggtcagtgacttctccttgaggaatgtcctgggctggccatgcttggctcactctcatcgatcccaatacaaaagagaccacaaacatggggcctgtgtcaccctctcctgtcctagcatttctctatcattaacctaaagttgcaaggcaaacgtccttgtcattgttcagtttggttttctactattttcataggaagggttggtctggtttatctagacctgtttgtgaaagagaaaacctctcttgaatttggttttgcccagggcattttcattttcttcaagggttagtacaaagagccttagtctgctgtttcttccaaccattgagttaatacagatgtggccaaagaaagtcagctgtgaatttgaaattgcaaaggaaaataaataaatagaaagctccaggctggagagatggctcagtgggtaagagcagttgctgttctctcagaggacctgggttcagttcccagcgcctctaagatggctcacaagcagccttaacgccagttcctaggatccaatgccctcttctggccactatggctattgcatatacaaggtgagtaaacatacacgtataaagcaaattttaagttttgggttttttttttagcaagcaccaagttttttttgttttgttttgtttttgttttttgttttttttaagctcacaggaaaaatgctggcattggtaatgattccttcctattttatgctagcttatttttagcatacactcagctttagatttttaaaaattaagcagaaaaaaaatggagtaaaggttagagataaaatagccaagggtattgccagtgtgatataaaacatgctggttttatagggaaaacatacctctgaagtgaaaatttgaaatttaagccatgaaggtaaatattaatatgttggaaaggaaaaaaagggggagataatgcattgacttcaaaattggggtaaaagcagggaagcctagtgactcatgggagctaaggcaggcgggcagccatgctgtcattcaaaaatagctaaatgttctgggattgggaagcagacacctcagggatgcttggtaataggttctccattttacaataatggggagggaaggaagggaggaggcaggggaggagggagggagacagagaggcattgagaagaagaggtgaactgcttcgccatcaggataataatcccccgtcaaaacttgcttttctgagcacctagctgtgtgccaggccatcctcaaagctcctggctttggtcaattctctcgctcatgcccccacctccaccctctagccagccccagcctctcttatagatccgagtgctggagcgcagtctggcagctatctggccaggaggccttgctctctgtacagcttgcccggaaaacattggaaacagaagagagcaattagctcctgtgcaggtgtgagacttggaggaccaaaaattttactgcaataagggaacagagacaaaatagaatccatatttatctgtatgaacacatttttttaattgtggggaagacaaaaggagtcacccgttaggagcatttatttgtgcagaaatggctttagaaatagctcttagtggtatttttttatggagttttctcactttccaagtataccgttcacagaaatatcctaatatggcagcttaattgctgaaaacttattatagaaattgcctttaaaatacagaattaagatctgtcttcttactcctgtttaaaattttattagaaatacttttattctaatgacaccaataacatctgaagcttgacgtgaagtagagacagacgcagacagtacataggtaggagagctttatctcaggtgctaactttagtttgtatttgtgaagggtgtgtggattggtctgggacgatgcctctggagctagctaggtgttttatgggcatagggaataggacatttctggcatgggtttacatcactccagatgcagccattctgtagttgttatctgaatcctgggcagaatgtaagcaggaaaaataactaggtgcttccatatgcacagggcatcagcagtgagagtgcagccttatcttcactttcttagaggcaaatgctcatccttttaaacaagtttatttagttggctaaatccctccatgattcattccctcagacaaccaaccaggaaataaaatcatagcaacacagaaaaggaaagaatagaattcgtgagaccaaccacgaggcaggactcagaaaagacacaatattctgctctcatctgagataggtaaagtttaaaatcattttaaaaaactaccataaaaagaagtaaagaaaaaaagtaaaatgttcaaagatcaatctaaaagacattttttttaatttctttatggtggatctgaaaggtcacttctatctcttttaattcattcacatgtggaaaaatagtccaagaagtaagatgagcaacacagtgaagaaagatggcagacagttatttcccaaggggagaggtttatcttcagatataaccttcatttctcagcagcgataaactcctgtgatgggctctccatctcctttaataacagtgtggaaagttggacactgagttatggtgggaactgtattgggtcctttgttccccaagcccattaattctggcttccccaagactgagttgggaaattctgtgcggagagctccctctgaagcaggcctagccttgtaggtgtacaatctggaatctttttgcttcgtggactcagtgctcagcagccttccactgttggttgttggttgaatgcctgccattgaaactggctaagacttgggcatacctggatgtaattccttgggtctcctatcaggagaaccctccaggcccatcacagacaactcacagaagccaggttgtctggtcaatgacaccatatggtaaaattctcctcctcattcacccagtaaggagcttccctcccacacttcctacaaactcctgtcaacaaactgggaagggagattggagcccatagcgcagaccactctgacaggtgagctgtgatgtcaagctgcaagacccagggatggcatagtgtggagagtgctcacctcaggcatggtggcatatccatgaggatcagtcactcaaggtcatcctagctacatattagcactgaagccagccttacccattgccatagagttactgctttctttgcatatttggcaggcaggggtctcttgctcagttatatggtcacagaagtaactcattaactttgaaacaagggatccgttattttaatctaacacaggacccacaaatgatgtctctgaaactgctaaagggtgatgttgggccatgggaccctctctctctctctgtgtgtggggtcattccttaattagattatttttgtaatttaataaaatgtaaagtggtggcattaaattaatacattaaagcaaagcctgacagagtgggatacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctcaggagccagccagagtaggcagattggtgacagtgagaacagtctcaggtaacaaattgtgcaatgcctgaggaatgactgctaaagtcctcctgtgaccttacatgcttatgctcataaccccccccatacacacacacacacacacacacacacacacacacacannnnnnnnnnnnnnnnnnnnnngctgtgggatatttgtgcactgtgaaaatatattgctgtgatttggtttaataaagaactgaacgaccaatagctaggcaggaggtataggaaggacttcctggcagagagagaattgagaagaagaagaatctaggcgtgcagaagatgccagtgagacactgaagaggtcggacatatgggacagagtcacatggtagaatgtagattaataaaagcaggttaatttaagttataagagctagtggacaagcctaatctaatggccaagctttcacaattaataagaaatctccatatcgttatttttgggctggtggttcagaaaaagtactattacacacacacacacacacacacacacacacacacacatttttaaaatcatgctccatttgttgtttgctagaagtgcccacagaatcactggaaacattatattcctagccatggatgattatgggaaaagacacagatgaaggtcagccaatagaagaagcacactgggtggtgtcaggaagagatggacacacacaggctccctgtgctcccccacagagccaggacttgctgctctttctgtccctgccactcttctatgtgacagtgtgcaggaatcattcctacccaggaggctttggtgtcacatactctgtgtgtggctgaccttcacactctggcattccagactggagcttacacctgcagggaagagtttcttcccctgccctcctgggttcattgtctgagcattttgcaaattaaatgacagaaagactaattaataggagaaatagcagatttaattacatatattggcatgggagtttccaaagaaccaatgcaccaaaaggcagttaaacttagcccctatgagcaactttatttttaaggttgtttattttattttatatgtatgggtgcttggcctgcatgtatgtcatgcctgtgtaccgtgtgtgcttggtgcccatggaggccagaagagggtgttggattgcctgaatctggagttacagttggttgtgagccaccatgtggaggctagaacttaagcccaggctcttaactgctgagcgacctctcctctccttgctaagatactactttaaaacagagaaaaagaagaggctctttgcttctggggaagagggatgaggctctggaaggaaacgtggcaagtagggattgtttagtaaggcctattgtgactataacagtccttagtctttggggtagctccttcttggtttgttagaggtagctctctttagaaatggacatggatgccgcgctatcagacagaaaggaggccagagagctcattgctttgaacctcaaacaatcctgatgttagagaggtgtattttgagcttctatctatggatctccagcacatttggtgtctctagcttctgcagaggtcagaactgatacactgtgtgtcaccttaatccatgctagatgtccagcatcaaactgccagcaaagagactcctgtgagccagagcattctaggtcctctgcagggcccaaggtcaaaggccagtcttgtctatggagaacttcatttttttaaaaaaatatgataatcttccaatatttaccattcaattcaaagttacaaaactattaacaccaatcacagcccatcagtaccattctctcggatagtggaatagagagtcaactgaggagtttcacgagccagttaccaaacatggacataatcaaaagttaagttttaaaaataaagttaataaaatgaggatggaaagacaggaaattaaggagacatggggtgagttaggttgcagcagctcaccagctgagagtcaataattcagtacagttaacagcatttgctgtggaggtgcctgacgaagacacaacactccttttatgtggagatattttcaaacaagaaatgttaaaatagcagggagccatgtttaaggcttgcatgcccatgaccttgaagtatgctcttaactcctttcaaagctgtaaatctgcaattttctgggaatttcatgaacaaagctattaactttatttgtagttgtttaaaaaagtggtctaattgccctgtacaccctctgtgagctgcacctttaccttgacaactgtaatactatctggagtacctcaggaaccaccctaactctcatttacccaaatgaaggcagggagagagggagagagggagagattgtgggggagggaagagagaggtgcagaaatactttgaacaatgtaactccagatgtcacctacatggcctctcgtgtgtgtgtgtgtgtgtgtgtgtgtgtgtgtgtgtgtgtgtgtgtgtgtattacgctttcctgagtgcctcttattttgtcaatgcccgtgctgaatgtctatgccaaaatctcttaacaaactcaagctctgcttcatactgacccatcctgagattcttttccatgttggagaatcccactttgcccagtagacttctctgaaaagatctcttcaagctacatctgtgtctcagcttccctcttaccctgctgctaacaacaaatgtttgaagttttataattttttaaagtcaccttattattcgtcagctcctggtcttatttacagacggtttctgcctgttgagcaccctgtagagtaccaccacgaggcgctctctgtgtagggttgccacctctgtagcacacgatggacccgagtgagcacagtatgatcagtactatgaccaggaatttttttcatctttgactttgagatacttctttctgctggtcaagtggttacaagaactgttgagaacatgttacaggccgtgacaacactgggccaaatgtctgataaattacctcaaaatacaaagtttgtatagagctcatgaacccgacccaagagttttacctaaggatctcactcttcatacaaccttgttctgtgtgactctggatttaattttaagtgtaaatttatacaatggcatttcagtgcttctgacattttgtgtaaattgtggaggatgtatgagaaactaaaactagcattttgatttataagtgtaagatataaatgtatgcatgtaacacttgcctcttgtgaaaacagtgttcttttctgttgtgcataatgatttcagtgtgagttctaagacaggggatgtttacttgtatgtggcagcagtttcaaatgcagagactccagtccttcccattgctggtatggggctcagggtgttcgttcccaggtatggttccttggtacactggacaaaaagagcctcctgactttgcctgaagctggtcacaagactactctagtcagagacattcaactttaaggaggaaggtttattttatctcatattttaccaggttgcagcttccgttcagtggatcccagggctttggatcagtcacagtgggaagtgtgtggagggacaaaaaccctcacctaatggaagaaacaaaagagaacagagactaggggccgctcctccttaagggaatgcccccattgacttcacgcctctcctctagacctgacctcctaaaggctccttcccctccagatacagccacacactggggaactaatctcacagcacagaaccgtgcagaactgtcactgaacatggcagtgaagcaacgagccagcatttaagaggtggcaggggtgtcagtctccaaatgtggagacactaaaatgaacttgactggattagtgtggggagcaggggaagccctgtatatgtgagtgaggagtgtgtatgtgtaggtgagtgtgtatggtttgacatgggcacctcatgttaagggtcccaaagcctcagacctaggggaaatgggaaagccttccctccctatcggaatgtgaatgttgacagcgtgtgcagaaaatgaccagcatagctttcttccccccagatatttgtgggctgcaggttgctccccctcagagtctgctcctacagagattagctaaacctgtctccttgttcagcagtatataatcaccccaactcttgtcaggttgcatgcaataaccctgcctccttgtgcaacgatccccctctctttctttctatctatctaatctgtatctgtctgtctatctattgcactgagcttttatggtgcagtgttttctccatcagagagctctccccacctgatcccagcttttctgtgtgtccctgtgtctgcctttttttcattccctcactgccccatcaggacaagttcttggagctctgccaggatgtggcagatcagccttgccaagtttccccggttactgccattaactcacgccatctatcctatcatgatcctagcccaggatcttctattctccagcaaactgaataacacaaacaaacccaaacaaaaagccaccaggttgggacatataagagaggttcacaggttaagagtactcactggctgctcttccaaggaccagagtttggtttccagcaccacatagcagctcacaactgcctgtaacccaggttccaggggatctgacgccctcttctggcatttgttggcactgtatgcatgtgatgcacagacattcacgaaggcaaaacacatctattcacgtaaaatataatgaaaaaaaataccaggttcaccagtctttgggacttcatttctgtaatctcctgggtcttttaagtcatacattaaatcagtttatagccttttcttgttaatctgccatcgactatgtggacccagataagagccaaaaagttcaggaggaaaaagatatttcctttcttctaacatgccatggtgcagtgtccacacatgtgcttttgtcctgtaggtgcagggtgacagtgtttgctgtctaagcgatggaatattaatgataagagatgtttttgagacttattcctgtttgctttgtgaagctgtcgttgcacagtctcaggaatggaaagggaagtcagtttacctccacgtaaagtccgtgtcatctcctgcctgcagcctctgcagccaccagtctaagacccaggaagaccacagctactactgcagacatgtgacatcacagactgttctcacttgcctggctaggtattgggcaagtccgggagcacaggttgcctgttgctgacaggattgtcttgaagaagagataatattcaagttactagatattaagaatagatattttaaagtatagttgtcagtcattttgctaaatttctgcctttgtaacattgtactcaatctcctgtacataacctatctgattagggagtattgttaggatggaaaaatcacagtggactgtgttcaaggaaaaacaaattattggatgatacttgttaaaacacagtcagactgactttattcaggataatggtggcaggcatagaaccatggcaacaagatcttgctgtggggaaagggatcaagctcaaccctgaatacagccaggagtcaagcaggaattggcattcaggagctgtgtgtgtgtgtgtgtgtgtgtgtgtgtgtgtgtgtgtagtgtcattggatgaggtattgctaaaatactatatcagagttaagaaggtgctgttctctgaatgcaaattgtacccccattgtttgaatggtggtgctcttcctgcagattgtgaatcctctaggaggtggagccatactggaggacgtgagccagtgtggggggttggaccttcctgtttgctatcccacttctgtttcctgctcatcttggatacgaacaggatctcgacaccttcctttcacctccctcatttttcctgccatgatgggctgcgtctccccacgctgtgagcccattcaagcccttcctcccttttgtggcgtctccacagtgtttcgtcacagtatcaagaaaagtaatgtaagacccccccccccaaagctcaggcctccagggtctcagcccaggacctcagccaccccaatccctattcggagtcaaaagcttgatgcaaactgcacgaggctttattatagttgtttaacgagctaaccccatgttagctctggtctttcacccacccgccatggcagatggctagcaaagacggctcgaagcagctgcatagagatcttatagggcagcataaggggagagtctaggggtatgcacaggctcaggattggtgtgcccccaggctcggagggcttgccctgtgttgattgggcaactggttgttatggcccataggccctcccagggtggttgctatgctctgcatgtcattgctgtgcacttgtctgtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaagggggagctggtcccttcggtaacagttataagaagtttctgactgaactgatacaccaggataaatctgtagttgggtagtcaggcattgctaaatgcatggtgaatacaaccctgatcaaatattcaggatcatcaaacttaaagctggatttagactggattttgtagggctgtgcatttcatccagggtcctaggctaagcttatgaggtctcaataaggtttggtaaagcaaagaatctttgcagttaatttgaattcagtttttatgaaaatattgacttgcctttgatttatttctagtgttcaggaatcctgttcctaagaagtgtgtgaatgactctgcctgagcctcagaggcacttctggaattatttgttttacaccggctctgggtggacacagatctctgagaaggtagtattcctgcaattaccaagatcttaacaataattggatactaagtagcaagatattaaatctaatttccttttgggcctctctgttagctgagtgttttgtacacagagagaggagcggccaccttgatggccgctgctctctgataccagcactctatggcatggagcaggattgggtcaggaaatgaagaggctccaggagaatcttcctgcgggtgcccctgggctcacaatacatattgtgaacaatgtgttgggcactggagttgtcatacatcgaaacacacttattacttccaacctgtggaacttcaagttaatctgaacaccacagtgtcagtggcacttcctggagcttcaggaataccaaacccaaccctcagagtgtgttttctgtgcagtagatggccctcacaccattgccaaactggaaggctccaggctgaaccttgtaagtcagggatcatcttgattctgaatgaactccaaatcatccttttgaagtaaagatagtgaaaatgtcactgaacccagggtgtagtctgtgcttcccgaatgtttctcccctctttggagtctcagctcaggtcactctccagcaagatcataatcactgacagctgattttgcttcgcctggaaacccaaactgccaagatagggcaggagtgcgtagaggaagtgaattgccgtagagtccattctcggagtctctctcctggttttagggtattgtgcctagatagctcttgttcgtcacacacacactcacctatcaccagtgaccatttccacagggcactgttactgtttggctgttctagagagccagttatggtcgggaaatgtccctcttgtattgtttaccactcccaacacacatagtcaatctgtctctcacacacagactctaccacacacaccagtcagtttctctcacacacacagtctctcacataatacacatactgtctcttatacacagatacaagtcagtctgtctcacacatggtctctctctctctctctctctctctctctctctctctctctctctctctctctctctctctctctctctctctctctctctctctctctctctcagacacacatgcgagcacgcgcgcgcgcgcgcgcgcgcgcgcacacacacacacacacacacacacacacacagaatgcttgagtagctttatgcctcttcccttccttagcacagtgtgtaccaggtaaatccattttttaaaaattactatggaggaagcaaaagacacaagtgtgtggggtctggctagggcagacattgaggtttagatgttctgggaaagctgtcaccaggactcaggatttcaactttgcttctctctcatgaattttaattcaccaagaaaacaaataataaataaaacatcaaaagaggcaaaatgggtcaggtcttggactgtcttcctgttaatctgggaactgctgaattaagtgctcaggtgttaaaaattaaggagccattgggaagcacaaagaacaaattctcctttatgtttcaaatttcttttcttaagtttcttattggttgttgtttgtcggtttgttttaatggtgactttattttggtctggatgtataaaatctccgctaacttcagcaataaagtcacgtcaattcacaagtgtcctgagagaattaacaggcttttcaatactagggaattcagtgttactccggaatacctcatttatttacatattgtgattggcattcaaaagtagaacagtttcgggaaagaacaggaagtttctgagtcagaggcaatgccagggcggtcagctgttttaatttgtattgacagagccagggcagcctcgcatgcactacccaggagacaacagtcacactcaagagatccagtaagacacaggtacaagtagctagctgggccaaggaggctgaggcaggaggatttccatgaggacagcctggcttccatagccattgccgggcctgcttgggcgacagagtaaggcagtgtctcaaaaccaaaaccaaaagaaagccagaagtgatgtgttcggcgcctctctcattgcttaagagtttaaaggaaaaaacaaaaggaaaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcgtgttctccctgctcagtctggtcctctagggtctacgtttgctcctccctgctcagctctgttctcctggctctgccccatgtcccctgggctctgtgcttggtgtccctggttctgtcttcagtaccttctacttggctctgggtcctcccggctctgactaatgttccgtcagcgaagccccggcttctctctgacagaggttctcggcaatctgccccaggacctcttcttccctccgtctggatcctcccggttctggccctgatcctgttgcgccaagctctgtccggagtcctcctggctctgcctctggttctttgccagggttctcaaccctgtaccgttttcttctggctctgtcttgggttctctccgcgctactcagggacctccccgctctgccttggtcctcccagctaagcctaggttctcccgcgcttcctggcccctagggctcgggctgcggagttgggacccagtttccccagagtctgggctctccctgctaggatcctgggggtttagggctggtggcccttccctatccttcccggtctactcatggagaccggccggttccagagggcagcgatgctccaagctattgcttctcccgggagcgggggtgttggactgttgggcagatgaggagtggagggaacaggatcgggtggcctagaatatccctggagctgccaggctatgagtgttccaggcggaagctggggagaggggttaggtaccctagtctgagtaccaggctttgtgtactgggccgctgatagcctccctaacccgaacatctccaatcccagcctccacatcctgaaactccgcaaccccnnnnnnnnnnnccccagcctctgagtccaccgtgtgggattcacactgagaacgcgcaaagtggtgggggacctgcctggggtcacagagaaacctttgcctagctccggaatcatgactcggcgtttctggtgtgaagtagtggatccggacgcgtttgtaggatggggtgtccgcttggatttagaattctggggaaaggacgagttggagtcttaagaggtgaacgccattcagtgtaacttgactccgcctttgagctggtgtgagtgagtagcacagaacagctcacagggtattagtcccatattaacctgctttccaattcttgtcatccgaaccatagttcgtggcactaatctctgggaacagttggcaaagtgtaacagtcagcgtgggccttcaggcccagggctttggagaggtggccccatgacttagaaaaagaagcctggcagttggcttttcacgtagttttttcaaataaactaatgttttaaagacggcaagaaaataacacatctgactcccaaggggatgtattataaacatttatctttggaatgttgtgttggttttcaacccaaggatagccttagctgcagtttctccacctttttaattttccaagtgtgtgtgtttttttaatcttaaaaataggaatgcttccttttacacttggtgggctttcatggaatgggtgaggctgttgattaatttgaaggtgtgtaagctcacaacactgcagactttttacagctttgatccctggctggagcagtttccatttaaagggccagggttggatgcctgctggaggatgggtgtaagtgcaaggtgctggctgtccaagtgtttttaatagttcctaataggagttctgccttggcagaggaggaaggagggagaactgtgtagcaactccaccttgatatcactagcttgacttcacacacacacacacacacacacacactctgtgggaggtgttagtgaagaaggggaaattggctgctttgataggcaggggtggcagagtagggaaaggaggaatatacaaagtctttggggtattcattgtttatgcacagcagtttgaagtcaaagacattgctctttgatgtgggttgctttaagagtgctggctaggtttgtttgtttgttttgtttttgtttgtatgtttttttttatcaacttgacacaagctagagtcatctaggaagacgggggaagctcaattgagaaaatgatgcccccatcagattggtctaagcctgtgtggacatttccctggttaacgattgatgtgggagggcctggcccactgtgggtagggcctcttctgggcaggtggtcataggttgtaaaaggaagcaggctgagcaagccagtagtcagtgttcatccatgtctttgcatgttcctgccttgacttccctaaatgatggagctgtggttcagacgtgtaagacaaataaacccctttctccctaggttgttctaggttgtggtgtttatcacagcaataaaaagcaagtagaaatacagcgagtcctctttttttttttttttttaatggaccaattgagttgtgagtctagagatcgactaggtgtgactcggaataagttaccttatctgtaagagaaagcagaccagtcctgttccacatggtcagtttcaatcagagtagctacctcttcagtagtcagtgaggtgcccccccccccatattctagtacagtcacatgaactgaaggcccttgaatcttcagacacttttaatagttttcatccctttcccattcctcctgtttttgttttgtttgttttgctttcctttgtttgtttcgtgaaacaggctttccctccatatcctgggctagcttgggattcactatgtagcccaggatagttctttactcatggtaggtcttgtgccttggcctcccgagtgttgagattacagattcagtgagctgccgtgtctagttaggtctgtattacttgagcctgcaagaagggatggaaaactactttgatcatttggtatgactcaagcattggcctagtgtcctgactgttttttgtgtcaacttggaacgagctagagtcatctatgaggagagaacttcaattgagaaaatgccttccgaatatggggctgtaggcaagccagaaaggcattttcttaattagtgattgattgatacaggagtacccagcccattgtgggtgttgccacctccgggctagtggtcctgggtactaggaaataacactgatataatgtgtgggacccctctcccccctagatttaaccagctttttcataactattttatttatcttggtgtctatttagttctctgcagttttatgccaggtgtcaatttctgagattctactgtagttacaaagcctaggacacattcatcacgtggactctacacttcttgctcatgatagcaaccacccaagctctagcgtctaatccacaaactcccaccctgaccatgacaaccactaagtctccatctctataattttatcattttgatgttatgtaaccagaattgctcagcatacactttattgagattttttttttatcttagcatttctctggagcttcattcaggtgcttgtgtgcaacgaagagttcattccctttcgcttctgagcgaccatctattctataaaccacccaaagtttattcgatcatagactcccaagtcaaaatataaacccttttctttctttttgtttagaaagtttatattcttgatatattaaatgtatgtcacatactgagatagaaactgtcttcagaacagcataaccaatttatacataattcttttgttgggcaaatgcttgtgtataaagaataacagccacgctgttattaataaagagcctttcatgcttctcacataaaaagaaaggtgaagttggctgaggaaaaggttaccagatcatattagctgtagagtctacagccgtgaaacaaggtgtgacaggattgtctactctatcactttagctctcttgtaactgtttctagaacccctttcccagggtgtgttgcagaggtttctttgtccagccaggtcccgtcacttcagcctcaaatgaacacacagagacactgtattaattataaactgttggccaatagctagggcttcttattggctatctctgtcttaattattaacccataactactaatctatgtatttctacatggccttatcttattggagaacaactggtgtgtccaatcctcccagttcctccatgttgtctcttctgcctacccttcccagaattctcctcgtctcctagtcctgcccagcttcctgcctctactggctattggccaagcagtgttttattcatcagccaataagagagacatatttacagaaggacatacctcatcaagggtggctctgcattagggctgaccccaggagacatttctgagaggtttgaaaggtagagatgaagcagctgtgatcaggctgagaagattggtgtaggttttgggggctgtggaatcctatgcagattcagcaggaagttttggctgttcatggtgacagcagtagctcaggtcacacacaggcctccagtctcccctgagctcttcctcagttgccagggtgtctgcacagctgtgagaaactggagtggaagagtcgggccttctacaggttcaccttgtcaaggtggagagacagtgtactgtagcatagtgtgtctctggttctaactcattcttgctttccctacttcctttttcactgacctctcttccccactggctgttttgttggcttccaaacccaaacatcacacttgcgtagatgaggtaatggtgacctgtcacatgactatagtaaatgttttttttttttttttccagattactcctgggggttctgcctaagtgttgcaaacagtcacctctgccccttgaattgctcagtcttgtcttaggctcgtgaacaaggacaggcaggaatatttttattaaatatatttaatgggggagggggacattacacagtttccactggcttgtgtcctgtaccttcagtgtattcaccccatacctttccctttcttctggctgcccctcccccttgtcccttactggcttctccagatagtgtcacttctacctgcatgttatatgtgtgagtgtgtgcgtgcgcgcatgtgtatattatatatatggttttatgtctatataaaagatatacaagaggaaacatctggtatttgccttttctggtctccagttgcctccattttactgtgaaggacacagtgtcacttcgctccctggtcatggcctctgaaatcaggaggaattgcattaaacttctctgtagacactgaactgaaacagaaccgaaggctacagtgcccgcaactcccccttgaaaaactgccttgattgatttaagaggtacttagtgttttcattttactcctttcccctttcctcttggggagaggttcctgtggaaatttccattcagccagtgagtggagcctgattcaacaatgaaccaacccgtggtcttctgcgctaaagatggggaagctgaggctgattacaggaccttaaactcacggtttttctttccatgtttaggctattagatcattgtttgctataaagttttactgaatgcctctgaagctaacataaatcataagagtgacgtgggtggcttaaatgtcagagctaaaaaatagaaaatgttaatctgtgtggctgtggggacctgtgatgctttaatgtttggtaatgagagattttaccagttctcatcttttagtcagagccttctgccagctctgagattgtgcaagcattggcttccatggcttatacctgagagccctgaaatgttcatttgggtctgcctctgctgatctgacttccttgaggcctctgtctctctggactgctttctatatactctagaacagtgagtaaagatggcctgggatacttggttaaggtgcccagacattctatgatggtcacacaggcaagggaaaaaaagatttgaagggagtaaagtctctatgggaaaaataatttttttaaaaatgaaatttctgtattaaactaagagatccctggaggtagagattgtgattgtggtctcataggttagtctagacctcagtctggttgtataggaagagtaggaaaggagagaaacccagttttggattgtagggtttttctccaaatttctccctgaaggaaatcataggattttctcaaaaagcagtctgtttttatcaacaaatgtctttctattttccttgcagccacacacttatttttttccagactttgagtctagcccttgctctttatgaggactgaggaatgtttggtcatgccaaaggaatggtaatgtgtctcttcccattgataagacatggtggcttctgcctgcaaagttctggactcctgcctcccacgccgatgtctaggctctcatttccacccagtaccctggagacctggcttcttcacaggtcagatttgctgctgctgagggcctctgcgctgggcagtcttctttggaaaagcccttccctaagctgcacagggctggctttctctgtaccttcagtatttgctgagacattactttgtcatgggggcctgcccaggactcctgtctgaaccttctcaacgtttcacctttactttcttactctgatctgttagtcgcttttccagcactgtgacagaatacctgagagtagcttacagaaggaaagtcttattttatctcacagttctagtctatggttggctggctctgtggtttctggggctatggtgaagtacagcagaaggcttgacagagccgagctgctacctcatttagcaggaagctgagagtgagatagagaggagcccaggaccagatggaactgccaagaaccccatgcccggtgatcaacttctccagctaggctcaacctctctataacactatcgaattactagtccaacaccagaaaatccatgcttaggtcagagccctcatgatacaaacacctcccagtggtttggtccaccatctagggaccaaacactcaacacaagaaccttttgagaggctgttctcatccaaaccctctataacccccactgctatctgatatcattctgttgttgttgttgctggtttcagtgttctgccactgctctgtgagctgtctataacatgtagcgctttacttggtttgcaaagtaggacttagaattagacatggaatcctctttgcgtaggagatctgcttggtttctgtcttatttaaaggcttttgttttaagtgtgtgtgtgtatgtttatatgtgtatgtgtgtgcatctgtgtgtctctgtgtttatgtgtgtctcagtgtgtgtatatctgtgtgtatttgtgtgtctgtgtatgtgtgtgtttgtgtttgtgtgtctctgtgtatgtgtatgtatgtgtgtgtgtgtttgtgtctgtgtgtgtttttctgtgtgtatgtgtatgtatggatatgtgtctgtgtttgtatctgggtgtacatgtgtgtgtctgtgtctatgtgtgtgtgtctgtgtctttatgtgtgtatgtatatgtctctgtgtgtgtttatatctgtgtgtgtctctcagtatctctcagtgtgtgtatgtctctgtgtgtctctgtctgtgtgtgtgtatttgtgtgtctgtgtgtgtgtttgtgtctgtatgtctctgtatgtgtgtgtgcctgtgtgtcttgtctgtttggtgtgtgtgtgtatgtgtttgtgtgtgtgcatatatgtgtctgtgtatgtatgtatgtctgtgtacatatgcactggggcacagcacctgtagagatcataacaggtagccagatctccctgcagtgatagattgtgaactgcctaattgggaacccaactcaggttctccagaaaagcagccaagtactcttagccactgagccatctctccagcccagttttctgtcttaatttacctttctccctcctctctcaaagagaaaagtggaagcagaagggggatttccttggacattgcagaggatctctgagggtcctgtgtactgaaggtcaagggcagccttgactatagaaggatgattgtggctcacagttataatgttgagagaatgacaatctttagtctggcaccatctcccccccacaccccaggatgccactgaagcacagatagttgcagaaagcatgttgcaagttccagacaggaggcaggaggctggggcaaagcccagaagggggttctcctcccctctcccctttgggggcttaagatccattcataacaccaccttgctttctataatcaaatggagcacaaggaactagcctatccagcgatctagatttcatctggtgtttgctttgtgttccttcagagaaaccttctttctaaactcttgggatttctcaatgtaaggaatttcatatgcttcagggtggactcatggttcaccatgcttgaggagcaagtgacgaaaaaaagaccggttatgattaaagggatgggctttgagctgtgtgatatttgctctaccctcccatttgaagagggagatgggattgaagtcctgtgtcaatcaagtgggccaaataatgaagccccaaatcataaagcccccataaaactctggagctcagagtttgctcacacttccagtaggttctctgccaccctgatgctctgagctgggtgcatcttgaggcttggcaaatgtgtgtgtttaggattctccaggcatccttccaggcgtggctagctccccttggtcctgagttttgttcttaatacatgactgtagtacagcagtttccttggttctggaaggccttctaaagcactggagaaccagagagaaatgaggaaacactggttttatagtaaccggtcagaagcacagatgctttggggatatttggagtcaggagtctcagaaggactctgcttggcctaggctatttcctgtaactttgggtagtccctgacagaactgcaatgtgcccaggtatgctagggaacacacccttctcaaagaaagcaaatgcaaaattaacagtgtagttactactgccactaagatatgtgacattgggctcttctagttatttgctgattctctctttcctgtgttgtcaccagtgttcttgcccaatgtccctccctttagtgtccttccctttagtatgttattactcagaatgccaaaaagacagtaatggtggttggaatctctcctggggagtagctttctcctgctgagtgaggatgggaggcccgagctccagtcagaactggattttctccacgctgtggtaccggtcagttgcagagtttgtttcttcagatggatgaggtgatgatgatttgttgatttgtctagaactagaaggatggaagaagagagccagaatgatcgagcatctatgggaatcgcctgaaagggaaaacaagctgagccagatgttatttattggttgattgagctaagatgaacgtggaaaccattcccaagcttgacaactgcagaacggctagaggtggctatagggaaacaacagaagatgggcatgttctgtgtgttgtactgggctgtggacacccaggaaaaaaataccataaatggtgatagagttggggtaatagctcagaaggtaaaatgcttgcctcgcaagcatgaagaccccgagttcaatctccaagaaccccccccttttttttaagaaaggagaaaagagaaggaaaaggccaggtatgcttattagcccagtactggaaagacagagacagttagatctctggggctcactggctggcaagcttagcctacgaggcgatctgtctcaaaaacaaggtggatagcacctgaggaatgacaactggggttgttcaaatgcacacgcatccatatctctctgcatacatgtacacatgcacaaaagaaacaatgataaagggggtacacttacccccgcccccttcctgattgctgttttgtttttttgttttttgatcttaaagaatgcttgctgatgagcacactgagttttctgttgaacctgttacccccctcgtgccttcgactgagctttgagacccatgtctcgtagccctgctagttcccttcctgggtgcagatctcaggcttcatctctatctgctctatcctgagatgggatgggagctgaaggttgcacaaagaagctcggtgaccactggtaaccccaggaggcctctgtttagggagatgaaagtgtcacattgtctttagttcattgtaattcatattccaggcatctgcagctgcctgtactggtatcttctgttccaatacagtcctgctccccaccccaccaccaccccccccagaggaggggggcaagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattacttcaagctcctgactgtgagagggaggaggcaaggagctaatgccctttttgcctttattctcctttggtgtcagattattggacgctgggacctttcttgggacctgatgtggcagtcctggagaacagccagtctgagtgctttgagctcatgcccccttctcctggtcagctgtgtaggaagacagctggctgaaaagaggaaggggagtctattaaactgagaggcttacagacggtcagagattcctgttaagattatttcagaaaaaaaaaaatggtcctactgcttgacctagttctaaatgagaaataaagactaagccaaataaaatgagagactcttagagctgaaaaggaaagatgggattttctgactcccagtataatttagattcatttgtttactcaacagatttcgtttagagtctattatgtgctgaatgcaatggatttcagtgatgaagagatgttagcttctgaaatctctgaaaaagtgctcataactcctgaagacagttgttaatgagtgcctcatggaggcactgtggggtgacctggaacctgagacactattctggttagatggtgttcttggccccatgctggatgccacctgtagttggtttctcatcctaccctccagttcccaaataaccattctgaggctcaatattaattagaattgtagttttttaaatgtttgcaagctacattggggttttctagaagcactgaactcataggatgtatgcatagtatttaaaagagttgttgggttgggttatgtgggagaggctaggtagcaaggaccacctccttggtggagaagctgagaacactgtagctgcacagtccctgaagctagatgccttggcagtcccaatgtgatgaggcctggaaggtccctgcagagctgctgaggctgaatcctcattggaaggctgaagaagctacgatgtcagccaaggactcactcaggtagaagcagaggctgactagtgctgccttctccttggatctctttgtgtcttggagtctcttttgaaaagtgatgcccaccttgaggatgagtgtctcccctcggccctttcaggaaacagtgccatggacaggccccgagttatttccccttcgtgactctaagtcccatcaagttgatgacagtccagacaggcttctgtgctgctgctttctcttagctgaagacttcatggttcttttcctctcaaggttggaacctcagctgctgaaggtgtcagctgacccagtcactgaggggcggagcttcggttctttggtatatacagtacctcacgttgtagctccatgagttgtaaaaatgaaaatcggaaaaaagagagaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagatgggaggtgggcagggcccttttaaaagggaacgtagtgaatgtgggcaggcggtgctcttggtggctgcagctaagggcgtatcctgtcaggaccccaaggacaggccagtacagatgcctgaatactagcaccatggtcatacctccttttctaggaatatactttgtttactttaaacaatagacattctgactatctctttatctcctgtgccatggtaattgagcggctctcactagaagcacattagagagcatggctaattgtgaacatttgccctaatgaaacaggcaccctatacccccatgtannnnnnnnnntgtcaagtcctctaatattttgagataaattagaaatgcttatatgtagacatcttaaagaatattggttgactaaaagattaaaagagaaaatagatataaagatgaaaagaaactatttactggggtgggggggtgaaacctgacctggggggtttgtttctaatgtaattagatcttgcttcccaccttgggtagacttggaataagcaattgcattgtctcaatgtttcattcctccatccatcatctacttcagtatttactgtgtgacagccatgagtgacacttgctctgagacactggagagcgacgctgtaagctccataagcatcacatcccttgcacactgatcacatttttttttttaccatctctctagtttgagcatcccccatgtccccaaacctaccttcctgagactccattttagagggccctcaccatcctggagctccctcgtgcaggggaccccagtgtctaagatgctctctcagccctgctgctccaccttgggtaccattgtccttgcctctcttttccacttggagaatgttttccttgttgaaagctgtgacttggaaggtccttccattgctggagctctgccactgttagtgatctgagcatgctcgttccttgctcccactactctctgaaccctttaagagtagacaccatatcttctctttgcatctctgggccctgcctcgtgtggttagcacctagaaaaatcttgttgaataaactgaaatgataaactgttgagttctgtggctccttgtctctctgttggtgatttgtactctttagtgtcaggagaacatcaactttttcaggtgaaggtaacaacctgctctgggccatagtatatgtacagttctaatctggatgcaagtattttgtacccggtgagttttggctcccactgtagtgttgacatgaacacttgtggccatgtggcccctgaatctcagggagtcttccagtgtacccttccccttaaagtaaagacggtgtgtaatctttgtagtgtggattctgggctgttggtcatggcattgggcagatcagagataatacgaggatactgtgacaggcactggaggtctcagtcctggaggacgttgatgtattagtctccactctgtgttggctgcaaatccatcctgggctgtcatgtatgcagtaggcagacttcaagatattttgatgaatgtctgtgttaagacatagatgcagagcatcgatcacagtccctctcctattaaattaccaaatttaatcagttaaccctttcttctgtgcgcctgtattggcttccagaaccagaaactattctctgcttacagacaggcactgtttggaaattttgctagcattttgaccgaaacttatgcatctctatcttttcacactttctagatctatattttataaataacattatgaggtgtgtgtgtgtgtgtgtgtgtgtgtgtgtgtgtgtgtgtgtgtgtgtgtatatgtgtgggggagggcannnnnnnnnnaaaatcactcatccttagttcattcttctacattattaagaccctgtctcagtcaaacctagacaccaaggcgtgcactgctccagtcccagaaccctgatgatgagcagtgaggtaacaaagaaaggacaaatatacaaatgtgggaacaggaaagctgggaacagatgggggtgtgttcactggatggaagccacccctggccatccagaacctctgtatgcttattaggtacagcacctgagtttgatcctcaggcccacatggtagaaagagagaactttattctctcttcgggaaaggagggctcccctaagaagtctctataggtgaacatcacttgggtaaggcttgtccattcccatgggacagaggtattggagtccttggcattgctgtgcccatgtcaacaataaacaaccactcagggattcccctgcttcctacactcagagcttaccaaagcagctagtcttggaatcccatctctacttgctcaagggagaaagagtttattttggcttacagttccagagagatacagtctacagtggtgggggaagtatggcaacaagatgactggagtgggaacaggaacattttcatcttcgtataggaagcaaagtaggagaacaggaagtaagggagagtataaatccctcaaatccttctttcaggtaggtacttcctctagcaaagctacgcctcctaaccataacttcctcaaatagtgccacctactggggactaggtgtttaaatacatgagcctatggcagtgatatttctcaaaccaatgcaaccagtgactgtggtgtttagattcatgtgtccaaatgaagcttgggatgcttagagctttgaaggtccaagccgtgtgtgaatcaagctagctgtttagaatccgcattaaggtgacttgtacattctcggttggttgtttaggaaaagagggtgattttgtaataggggcaggtcaggagccctaggataaagacctattgttgctgttttgtttgatggactggagagaagacagctatagaccatcaaactacttactgtgtgcacaccgctgctaaggcaccctggataagagcattttctgtttgttttttgggtaaagggctttactctgtagcccacaatggtctcaaattcacaccagtccttttcccacagccattttagtgctgggattaccagtttttgccaccatgcctagtaagaggttttgttgagaaacattttttttcttctataattaattcctcatcagatcttaacctgtaggtagtgacccatttggttgaatggcactttcatagggtcacccaagaccatgagaaacacggttctttacattacaattctgaacagtatcaaaattacagttctgacaggaggaacattatcaaggggtcgaaacattaagaaggcactgatctatagacttagttggggacattacatcctgttatcaaaggtgacctttagatgtatctactctgtgttttggtgccatgaagatgtttttaatgatgttgagcacctgatttcccttctgtttgtagttctcttttagttggcttatcatagtgttaacagttagattctcagatcagtgggagattgtgttaaaaaaacaaaccctgtccatccagatggcttagaggatgaaggcttgctgccaagcctgatgacctgagtttgatcctcaggcccacatggtagaaagagagaactttattctctcttcgggaaaggagggctcccctaagttgtcctctcacctccatgtgtgcacagtggcatacatgtgtgagcacatgtgcctacccgctctattcctctcccccagacatgcacacaaaacaaatagtgtgagcaatgctgagaccccaaggtgagcttgctctttgtgttgtctcagcattcctaacgagccctgtgtggggtggcaacgagactcacttccagatggagaatctggaaacatggttcctggtggtaccatggctgagagcatatgttcatgcctggttcgtcctggctgagacacagttgcagtctcctggtttctgttcatctccagtgacctggactttgacaccagtacttgggactctccctctggctagaagtaaacacaagaatagtaggaaaggagcgctttcccaagtcatgggatgcctgtctgtctgccttctgtgaggggtccaagttcccggaatagcaatgtgctgtctctgcattgatttctgcagatgagccagttctgagataggaaaaagctggaccatccacaagcgtaaagtgttgagagttactggaagctattatcaaatagcttgtcttcttaaatgatggatggatctcttgtgcttttatattgtgagcatgacttgcacagacttctctatttttaatttttgcttttttacaggctaaacatatttctggctggcatgaatcctttctacttccatgcggtgaatgtcattctacactgcctggtgaccctcgtgctgatgtatacctgtgataaaacagtcttcaagaatcgcggactggcttttgtcacagccctgctctttgcggtgcacccggttcacaccgaggcggtgagtatagtggacactgtgaaataatggcacctaacagcctaacgtctatctgcatatatcagctaaaccaaccctccccctttcaaaacctgtgaattgaaaggcccacaccaccatcagcctcacctctgtgccccagtgctgctttgataatgttcacatgggctctgcccaggattcaattgcatctttgcacaggggctgtggttattataagggtaaaggagactccaaattttttatttgcaaaaataaatttaaatcccatgtgctttcagccagcaggggacattgtgagaccccccacacacacaccttgatgtcaccatccctgctctgcttcatgcctgtgtttacattatgaagctgcaggtgctgggggaaggaccaagaaagctagactgatgacattctgccagttacaaagatggacttgggtaatttagaaattgctttctgagttactgaatgagaagttcaatgattttgtgtgaggaagactctgttcagaaactattgctagtttggatctgtggccctttaaaaaaggtttggtctatcttgcacctgacgggatagtgtcatgaaaccactgtgtcatataacggtgcctgattccttttatatgtgttgctacagggaggtgaaagctttctgacagggccacaaacaccaagattttcagggaatgggtgatggttcccaaagagagaatggcttgctaagcctctgctggcacctggacactttcttgaaaatctacccaagagcacacttttggtaaagacacaacattgatctgttttggagtttgttctctctcatttggatgaggcatgctcatgcattgtgacctgattgtgtccctgtaatccacacctctgagacccctgcaaaaggacagtttgacgtgttggtgttgcgatgcctctgtcaattaaggcatcatagttctagagaaggcttcctggcctgtgttctatttccatgaagaatacaacttggcagtagaaatactgggtggtactctgtgttaaagttctgagtcagaagtgaaatagtgtccagagggattcatagaatgtttatttgaactggcatgggaattctgattcagttaactgatatcacagtgagtcttgtcaatttggtctgtgatggctgtgtttctgtgaacagaattccccatctctgagcctgatgtttgacatatatgtgtggtctctcatgtatatcattcacagggggtgtgtgtaaatatatgtgtatgtgtattagtatatatgcatgggcatctgatgtacacacacatccatatataattatatatggggaaagtgacagataaaatataccttataaactattacatcatttggatagttttcctaactctttctgagtatgttagactgggcaaagttcctgtaagtggaagagtttgacgtgtaagtgacagtcctccagtgtgtcttggtaaagctgattactatacttctgtaaaatagttacagtgagaggagactctgaagggcaggttgctatcacgactgtccaaattaaagtcaaacccggctgattagtcagattatggatcacaaaacttcacatgaaatggtagattccctacgtggtagttgcctctgactttggagttagaagcgctaagccatacctgtaacacgaatccttacgttcctatgcacgggaacagtctaaagggtagaggccagacttagaattgtgcggcacactatcttactcttctaagagaaggtggaccagacacagcacttaatgacacgcacaccttcatgtgtagtgcttaacattttcctgctttcatcatgatgtgaattataaccagaacactaatacataattaaaattataatatgtagagatttatggttgccccgggaaatttaaaaagtaattaagggccatagatacagctctgtggtagagtgatcgcccagtgtgtgtgaggccctgagttccatgtcttgcagcacacacacaccaaaagaatccatatgttttttcattatcgtgaggtaatgtgataagtaaagttcattttaacattagtatgcattaaataaaatacatttaatgttagtatgcaatgcatcaagagaaaatgctgaaggggagtagctctgaagaaaatcacaggaagagagcactccagaggtctccatggaaaggggaaatctccctagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaagaaaaatagccaaagatttctgctctccaaggccagggtgacattatgtttttgacaaatttgtagattacagttgcagggctgtgctgtacttggggacagctactgcaagaaagaccaactgattgtgtggccacagttttaattcaatggctgaggagagaagagtacatatgccaggcaaccttgagcagtgtgatcaagacctgatagaggatatattttagttctatataaaaaagaaaacaaaaggcaaaccctattagcaaaatgacctttagaaaggggtttccggggcttttgtactaataaaaaatccatagtaacacaattgaagaggcgtaggttttgaagagcttggtcattatttggagatggatactgggaagatacttgcttttgcaagatgaaggatctgtggggacaagaggtgaacagatctgacccagcacaccatttacactgtaaagcagagtggaatctgctatttaattatagattgaagctcaagtttctagggaggaggacagagagacagaagaagcaatgtacttcatagacaattagtgataaattattaagcatgcacagtaagacataggggtcttgggaaatcactcatctttgtttttaaaaaaagactgaaaattcgaccatatgttatgttattccaggaaggatggagaatttaaatttgggggtggaatttggtttagatccgtagatatgattgcgtgtcagcacgctgatgtggctggctttataagtgaggcagttagcaaatagcctagctacaagctaggcatataggtaccaggaaatcatagggatggggcgcagggtgcctcccccagtttgtacacaagctcacagaaagctggagactagacacacaaatcgatgtaagagaaacaggagagaaaagttaattcacatttaagcatgcagggacacattgattaatctgcctttcaggaagcatttgaatgcatgcatttggtaacagtggggtagtgtcctgcagggcagggactgaagaggaccagactgcctcatttaagccctggagattcttgggcaggcttcccactgttgtgtttctttgaaagtttatgcttttctgaattctcaatcatgaagaaaaaaaaattgggaaaatttaaacttggtcatcacagagaccattggtttgcagaagtgaaagcaaaaccaagcacaaagagtttgaagatgaaagccaacatttctagaatcagaacaggagggctcaggagagaattggctctgatctaatcagttggtctggctcctggctgttgtcacatgtttcatttgcgttcctggctctgtctgatgctaatggagctcattcttgcaggtaaaataaatatttgtaactctatacagagcctacttgatacaaaccctgtcagtagcatttctcaaaatatcgcattataacttggcggcaaatggagttctaatgggcatttcccacctgtgattttgttttcctggctgacaggctcacacatccattacagctcagacacccctaacctaaaattctcaaattccaaactctccaaagcctgaccttcctgaatgttgacatgttacaagtgggaaatccctctgatttcctgacctcaaggtacaggtcatgttgaaatatggcaacactaaaaacactgtataagttcaccctcagaccgtgtgtataaagtagaaagaaatataggtgagttttgtgtttagccttaggtcccatccctaaaacatctcattgcttgtacctgcatgaagatagtctaatctgaggcatttctggtgctaagcatttgggatatgagagactcatctgttttaaattctatctagccacattcactagcactttccagtgtgttaacagagctctaacacaacagcccctagtgatgaaggcctgcagcttgtggctgagagatgtgcatatattcctgcgcaccgtgagctgctttgctgccttgctatgtctgaacactggcggnnnnnnnnnnctgcagcatcaccagcgtgttaaccttctgcctctgctgccgtggcctcggcgttctccctattgacagtactatcacttctgcctccccttccagaactgccgccgggtctcctaccgtccaagaggaaggcacgatagtgcctttcctggtcacggttcgtcatgtgccccttgttaaactcctgaagtcttctttgactcttttactcttgggtcacagagctggcccttctgtgaagcttcttcccaggtcctgtagcgggaatgagtcctttctcttttctgccaacaatttttctttgtgatctatgtggtcttgtctctgaatgtaaaaaataaataaataaataaaaaggaaaggaaaggacatgactggtaggtgtggtggaggaagattgttgtggatatccaggagagtccagggtggacatgaccaggctgagctgggttccatagggagggggggagggagaaagggaaaccaggtgcagtagacagggggcnnnnnnnnnnnnnnnnnnnnnnnnnnnnnnnnnnnnnnnnnnnnnnnnnnnnnngggggaggggcggcccagccccagagctggaagagagtttagggtaaagggcagggtatgccagccataccctgtaataggtggaaactgagggatgctgggagaacctggcagccaggtcggctttggtatgttaagtaggcacctcagccccttgttcggggtttaaaacttgacagtgtcctatttaatactctcttctgactccagcagatgttaaagtccttgaggcaggcttatagtacctgcttggaaagttctcgatcactggaacaagcccacagtgaagacttgatagcatggactgacagtcacaggaaatggcagctgtagccaagcatttgatagggatggttactttgttatagaggtccaacactttgcccaagacctcagctcaacaggggtacacggtaggcatttaatgtggcacgctggaaagttgtggttcagcctctcgaggagcctgctagcatgggcactagcgctgtcacaccatctctgaacttctgctagtgggattctacattatgatgttattgttgaggtgagggcttactatgtaacccaggctggtcttgaactcgtgaccttcctgcctcaaccttccagtgctgggaagacagatatgagtcagcatgcccagctagtatattctttttttttttttttttttttttttttggtttggaggttgtcctggcactcgctctgtagaccaggctggtctcaaactcacagagatcagcctgcctctgcctcccaaatgctggaattaaaggtgtgtgccattaccgcctggctattctttatgtcttggtgcattcaactggcatagtcgtctgcgctttccagattggctcagagtgaggagcagggcttcaagacacttggcgggttctggttattcttgcatagcttttgattgctgtactccgccttgctatattcagagtcaacttgcaagtcttgctgttggctgtggtgatatcttgtttgtacaaataaagcttgcctgaagatcagagggttgagctagccactagctaaccatagagatctggaggtctgtacagacagacaggaagtgagatggctgggcagagagaggaattataaaggtgggaggagacaagaactcagtttttttttccccgctggaaagttgagtaggtaaggtggctgtggttttgctccttcgtctctctggtatctcagcatttccccctattatctgactcctggctttcattattaagacctattagaactcgtgttacagttggccacatcgtttgttccaggatgagcatccctctaggctttgcctcaggatgtcatggcaggctagggtgggctgtcttcttaacttgagttcatgctgagttaaatgttccaagacagcagtggccactgagcctatctgagccccaactgtgacttctgcatggtcgttgcttagcctgaactgggagcttgtacctttgtgtacactatcactgcctgcctccctggagccaggcagcttctccgatgtgactctcaagctccttatagatcagccaattaatgaacactccgtgtggtccaagccatacaggaagtgctatgttggagttaagagtttctcccttctccaaaacatacacaatgtagcaccttcgcatgtcacctcattggcaacagcagtctggtgttaacacctgagatgataaactggggtctcagaagtcaggggctcttcctcaccaacaccatggcctctctgactgtacagtgtgctcataacacagtatgtcagtggttcaaattccctgaacattatttcctctttatgttggttgattcggcagtgcacatggacctgggttcttctctgacttgggtgatgtttgctgtgcctcagaggtcagccttactcatctcccatgtaaacaactcctggccatgatggggaaatggtcttctggatatgtttatcttactggttgatgaataaaacactgtggccaatggggcagcaagataggcaggtctaggagatgaggaggattctgggaggtgtaggcagaaagcagtcaccatgtaggatgccagaggagtaacaggtccctgggcttttctacagtaagataagagcatgtggaaatacgtagattaatagagataggttagtaattaagacagagctagccaataagaagccctagtcattggcctacagcattataattaatataagtgttcctttggggctgacacagctgtgggaccaggctgatgggaaagggtgtttgtaacatggcccagctcttcctgagatgttgtgttgtttagtttttgtcaacttgatatgagctggagtcatctgagaagagggaacctccgtcaacaaatgccctcctagtctggcctgaaagcaagccattttttttgattgatgattgattcggaagggcccggcacagtgagggcatggtgccatccttgggcagatggtcctgggtagtataagaaacagatatgtataagaacaagccttggaaaacaagccagaaagcaatgtttccctatggcctctatttcagtttctgcctccaggttcctccttgagttctgctgtgacacgaaataaactctccctcctcgggtttcttttggccatggcactttgtcagagcaataggaagcaaactggaacagaaatacttaaaaaaaattatatgttcctgtttacagtcttatagcttgtattaaaaggagagagagagagagagagagagagagagagagagagagagagatgatcttcagtgtgagttttatgctagcacagcaaatgcccattccagcttctcaaacagcacttacttctaaagaaacttcaagcttcctgctcacactggctctatgttctttatcaaggcccactgatttttaacttttgctggttttgtgctgttattcctctcttcctccctctctatgaaaatattgtttgttttctgaagcagttacagagggctacataattcatgctccttcacacatcaataattcagttgtgtatttcctaacacggagagaattattcatggttttggtttcatctcttttagtcctgaacactgtctttctatcatataatacataaatttcaatatggttcagagtttacattaaaatgcatgtagtataaactgtttttgatgtatttgtgtgcaacttattaatgttatataaatatgtacaatataatgcataacacaaatacttattagaggcatagtatattaaaatatataccttgaagataaaaaataatataggttgtgtttaaataaatagaatgcatttaaaatgtacaaaatttaatatcattatcagtatatatacacatatatatacactagacctataagtttatgattttatattattacaagttataagtagtaacataattaggaatcaagattaataaaaatacaatatacaatgcaataaaaaatacaaaacacaataaaaataaatgtaataatatcttaatgtagattaataggctataatttaaaatatgtgtttatgtttaataacatatttacatcctctttcttatggattgtgtctctccttgaaattgtctgatttttctcatgcacgtgattaggtgtatacatccttggctagaacaggcctgcatggtgtctctgtcttatctttgaagatagttttcattttgatttcttggtgaacatggtgtgctgtcttaagatgtcctctccatagtgtcttcactctttcatttttctaaaaattaagttggtgagcaaccgtttgaagttgtgtagataccttgcatctcaaataaattacatattctagagttaccgtctgttcattttattggtgctgaggattgaacccagggccttgggcttgctggacaagtgctttactattgagttaccctcctagcttgactgatatttctggcttcttgttctatccaaactttactcttctagaagccaatgttattttccagctttgcccttttatccacaaacatcgatggcttttttagccagcagagtctccccgtgtttattcattcattcattcgccgtttgcatttaggcacttttaaccttcatcacccgtgtgtcatgcatgtggattgtagatttttgtgtcttcaatggtttataatatatcatgttccttatatttaaatcaagttttttcaagtttgctcagcaggagccccttttctttggatcctttcccctttgactaacattctgagtgcttctgtactcggacatgagatgatgatacttgctactcttgagtttccccaagcctcggccctagaatcagacttttccagggagccagtgtgtttttctgaggtggggcagtgaattatggatcattgacagacccatgaagccacacagacacacatctgtgtgcacacatgcgcacacacaaacatattctttttagcagccagcagtccccctcatttttaaaaatcctgatttctctcctttgttttccctccactctgtaaattctctgtggcccatcactgccccactctccaacgatgagtacaatgcctgacactcatgtttgatgataggtttctttgagactcacacccagggcattgtacagtctagccaagcacgctacctcttagctatgcccacaacccttaaagtgtattttaataactcaataactgaacaaaattttatgctgagaatttatcctctgtggaagagaacctagaaataaggttaagaaaaattctgtcactttgtttctccttctctctttctctaaatgtactgtggaacatatgtaataatcagaggtgactggaggtttggttcatagattgccatctgtaaatactatgctttctgctgtgctgttcatatgtctagaatcagatgcatttctgcaagataccgtgacaataattttccgagttttacatttttttccgttgtgttatactttctaggtggctggcatcgtgggcagagctgatgtgttagcatgtctgctgttcctgctggccttcctttcctaccataggtgagtgggattgagcaaactcttctgtggttttggtcacatactgccatatatacactaaacccctgtttgaccagagagaggctgtggctgtaacatgctcagtgggtaccagggagagaaacgctctttttacccagtgctcacctgttattttccaaccccattctgaagtattcactgtgtgtgtgtgtgtgtgtgtgtgtgtgtgtgtgtgtgtgtgtttgtgtgtctgtgtgcatgtagtgtttatacatgcatgtacatgttcacatggagacaagaggtcaatgctggttgtttttctcaattctcctccaccttaccttttggagcagggtctctcacagagcctgatgggaatctgtgtatctctgtgtataaccactcccctacccaatgctatgattgcagacatggtggctaacactttttttcctgtttaatgtatgccagggatcaaactcatgcctcatgcttatgcagcaggcacttcgcccactgaggcgtcttccatccctcagctttaaaagactgccatccccacgctgggaatccaaactcttgtttcttttgcttgttgatccctggctgaggatagaactttagctgtgaacaaaaaatagatgtgctctgttctgtttgcctttgatttgtttaatttatcttcatttcattcatgttttaccctgttctattattcttacaatagccactcacagttacataacgaggttgactgggaagtattgtttcttaactagagttttgcacttcagaatcttttttttttttgtcaaaatacaagaaacctctttctattccattgtgcctttatccccaaagtgaaggcatttttaactgacttgtaacatatctacatgtagagcagaacaagttaggaaaatgagagtttgaacagagtgctcagggtgtctccctaaagatgccaggtcagctataccaactgacttcgtagagagacgctagctgggaattggtaaacttggcctttgagttagatttctgctgcagctattggtagagaaaaaggaagttacgaatgaacaacccatgcggagtttattgacaagggggtgggggatggagttggattgtcagccaacccaaggagaggcagagtgagagagaaggggggaggctggaccctttaaagggaagaccatgcatgcgcagtgaggcttcacgcatgcacagaatcctcatgcaggccataatgcatggtgggtgatgtgatgacatagcatgttttcctgtgcgtgccgcccatcgttaggggggcagggtcagccaggtgcacatcccaacactttggatcaatttgatgaactgtaacttacaaagcccagtgattcacttttaagaatattgttctaaacctacaatattgaattagcaaaaatttcccttcttcctctagggtagtagttcctttggcatacctatgacccaaatatctgagagaacagcctaaaggaaggattatttatttgggctcaatgttttagtcaaaacttggttcttccgtcttccagtactctctctattcagacttggagcccattaatgtattaaatcactcattaggccagagcccttgtgacatcagtcacctcaggggtcacactgagcccctgtgacatcagtcacctcaggtgtcacactgggcccctgtgacatcagtcacctcaggtgtcacactgggcctctgtgacatcagtcatctcaggtgtcacagtagcgcttgtgacatcagtcacctcaggtatctctctagcccttgtgacatcagtcacctcaggtgtcacactgggcccctgtgacatcagtcacctcaggtgtcacactgggcccctgtgacatcagtcacctcaggtgtcacactgggcccctgtgacatcagtcacctcaggtgtcacactgggcccctgtgacatcagtcacctcaggtgtcacactgggcccctgtgacatcagtcacctcaggtgtcacactgggcccctgtgacatcagtcacctcaggtgtcacactgggcccctgtgacatcagtcacctcaggtgtcacactgggcccctgtgacatcagtcacctcaggtgtcacactgggcccctgtgacatcagtcacctcaggtgtcacactggacaagtgacactggcatgtagtagatagagagtaaaaatgcccctggacagatgtcctgcagtatataggacagacctcacaacaaggaatttcctggcagggaaataccaatatgaccgaggatgcaggtaccgtccagtggaggccttaggtctggagtgagatgcatgaaggctcaggaggaagagggtggagccagactagtgttcatctccaggcccactgcctactgcctactgcatttctaattgtgcaaacactgttaggaaatctgaaaacttaaggttggatttaatactttctattgggccagaatcaatctattgatttaatttaaaattttccatttggttgatgtatctgagaaggtgatgagctttgcatttgcccctgtctgtgtgggtgtgagctggatcatcacaggtgattgattgtatatgccctgctcacctttggaaatttaagttctagatcaaccccatggagaatgcacatttgccatctattttgcatgtaattttgtataattgttccaaggtgcaatacatagaagaaactgtcacaatatagacagagtgttggccctcacttcaaaggagagggagctagtgtctgtgtgcctatatgaggaaatagtggtacttcctagggctagttttatttataatttggaaaataacactgaggacatcataaaaattcctgtaggaaattgtgataaaaaataaagatgacagggcttgggagatggcagaggacccaaatggtttccagcacccatactgggtggttcccaactgcctgtaagttctgcttcagggatctaatggcctcttgtggcctccattgcaactgcattcacaagtgtgcataaccacacacacacacacacacacacacacacacacacacacacacacacacaattttaaaaattacccaatacatgtacgttgaaaataaattcaaatgatcagagtagtcaaaagaaaggaaaaatgcttaaagcctgcctttccatcatagagagaagtgctatttacttgtctccccccgttgagtgcatatacgtgtgtagaaacactttgatcaatcatggtgatggacacttgacatctgtcacttatccagtccttgctaacatgctaattctcccgtttctgcggtatggtatcccatttgctaactgtacatctgtggtttgtaccagggaatctggcttctcaatccatgcatatttgctagtaatgtgtgtcatttgcttgaaatattcacataaacatctttctatctactaagtctatccttatgttagtgttttaaatgacttttttagtgttcattcattacaaaccatactgcatcataatttgcataccgtaatttagttctaagttgatattttttggactttcttccatttaaacaacattttaagagatttaaaaaactgtgtgtgtgtgtttgtgtgtatgtgtgtgtgtgtgtgttctcaaggaggcccaaagaaggggtaggatctcctgaagctgcagtgacagggggttctgagctgcctgatgtgatctagactcccttcctttggcagagctgcaagagctcttagtcatctcttcagcccccaccattttaacagtttaaaatagttgcatggcaaatgctctgggagaaatctttgcttactgccttgttctacacgagatacatctctaaaagatactgactgtttcatagcaacccatgtgttgataaggaaatgcccaacttgctttgcaggagtctggatcagggctgtgccgggcagtgctttcccccgacagcttctcccttcttcctgctgctcagtctgtttctggggacctgtgccatgctggtgaaggagacgggtgtcacggtgtttggagtgtgcttggtttatgacctcttctccccctcccacaagcaggacaagttgtaagtcatttccaacctgtgttgttgtattggttacttttcctgttatgatgaaccttataaagtaacttggaggaggaaggtttttttcttttttctgattcatggtttctaaaactgtcacatctggaattgaaaggagctgttttgactaccagtcttcactcctggtttgtttgggttgtgtcctgctgagggaatcctgattcacaaagaaaatcgtgtcatgaatggtaaacattagctgcttgtgttgagcccccaatttctgatggctgttacccacgagtgagctccatgaacttgaaacctgtctgcttgctctagctgtgcaatctaacagcattaggaggttggttggagacattcttgggtattcatgtgctcacagttgtgtgatttttccagttgaagaggaaacttatgaagcaccctattttcctcttaaactgtaaaggtccatttgtttcttgtgtggatttcgatgctaagagtgactggggatattagaagttcaagcatgtacaattttctttcctcatcaagcccacagtccctggcagttttacatgtgtcattaagaaaacaaatgacaaatgttgataagcttgtggagacaagagaatacttacacactgctggtgggattgcaaactaatgcagtcactgtggaaataagtatggaggtcacgacaaacaacaacaacaaaaagtctatctatcatatgacccagctgtagcatgtctggatatttaccagaaagactccaaatcagcataccacagagacatgcacatgaatctttattgcaaccagctgggttcaaaattgacctaggtgtttatcaacagagaactctataaagttagtgtagtatttatatacaatggaattcagccatagagaagaaagaaatggtatcatttgtaggaaaatgggtgtatctggaggtcatcacacatggtgaattaagtcagaaagacaattatcttgtattttcctctcatttgtgggttatatcattgtgtgtgtgtgtgtgtgtatgtgtagaattcacttgggactgtcttgggaatgaagggaaatgaatttagaagaaaggaaggtcagagagaatggtggggggtatggttaaagaggctcatatacttacatgcaaatatcctcatgaaacctagctgctcgcacagagaatatgtgccaggaaagacaaaactgaataagaaaaatcgacaatgcaattatgcatttgaaagtagatagttgcaaatagcagaaacaggagacttggagacttgaagtcacatccttctagcagtctcagctagggaagcaaggggtagctgcttttctgtcacaagccttgtcattttgtctgacttgctttttccttaattctgtgaactattaggagcaatggggtgatctgtcagcacagcttacagcagccagggaacccccagtcctcctctcagcatggccacccccaccgtgagagcagaaaacagcgcttcccacacaaagacacttggggaggctgccatcaaccgctgccaccggagcccaagagcagcggattccctgtgtccccaggagcagtgtggtccctgatgaggtaggtactgggctgggttctccaccgtattcctttcttttgttgtgattgcccagggttgcagcccatggtgtctgcagagctgaagtactgagtcaactctctgggatggccttccttccccaagggtcttgactgtataggttggggactttcatggtgggctgggaaattagtccggaggactgtgaataccttgagggtggacactttctctgtgttgcaggcagttgactccaagttgttcatgcagtctttggctaatagttatttaaatgtttgtgagagtaaagaaattaagtagaccataagaatggattggaatcaaccataagaaaaaaaggtttcagtagaactagcaatggtgtaatgcgggggaagatgttagatagaagaatgtaagacttttgtttgcatttttattttaagtttcacatgtggggtttaggcccatatgggtgcagatgaactatgcagaggagagacgagagataccagagcagaaagtgtaaaggtgaaaatccacaagggtggcatgctcacgtcctctgtctactaacttgactctctgaaaggggagccaggtttatgcccactcatttccatgtaaatgtccctacctcagctgatgccaagctgtggtgtgacatcactggcctgtcagtcttcagtttctaccagacagaagacatcagcaaaatctcaagaaccaagtttgctatgtagtctaagtaggaaatgcccagagtggatgcgtaacactcttttgatgtactttgtttaagcttatctaacttgatctttggtgatagctggctttaataagtagcttgcaagattcctaaacaattagtcagtgcctattcctgaacatcaatgaagcaggtccactgtgaaagctgaaacaaacttcttatctgctgtccacccacctactgtttactgggtaggggagacacttgcacatcaagtcatcaccgtgtctgtggccacactcaaagttagcaagtgtgggaggctgggctggaactgggctgggtcacttagtcctatgctttctctaccacttgtcaggcttggagtgcaggatcctggtgagcacttactggaggttcccacttggaccagtttgtgtcttcttggctccttcattactgctctgggtttggaaagattcatgcagtcatctgtaggtccacacatgggaagtgggtgagagtttggtaacattgtatgttacactctgttttttcatccaggacaccatgttctagaagtaggccacattctcacctggtcagcatgattgtatggaaagatcattttccctcctggggaaggaaggctgccgtatgtcatctatttgagcgtaaatctattactaaaattggttaagaaaactctgcttatttttttgtcagatgtgtgattgggtaaagccactgagtttggagaggcaatggcatcctgccttttaagatctctggctcagtggacaggacattaagccacaactccttcagatgctctctgttaccctaaaagtaacatgccagattggctgccaggaccaagagtactgaacatcaacaacaaggaaactggtgccttgcagcccgtgttcttctgatatgccacagacccctgcatccttactgttagctcttacccttgctcgctttaactgctgacttgatacagtctagagtcaacccaagatggaagattcagttgaggaattgatgactttggcctgtaggcgtgtgcacagggaattgtcttaactattaattggtgtaggaggacgtagccctgtgggagtgggaccattccctaccctctgattctgagctgggtaagaaaggtggtgcaagcctctgagagagcctgtgttcagcagagttccaccacggtctgctctaagttctggccctgacttgatgtgtaagccaaacaatccatttctccccccgagctgcttttagtcagaatgttttatcacagcaacaaaaggagcctcgcacagttctgctgtgtcacgattgatcgggtctctgaacaccagggtgcaatgtgagtggtgagcctgtcctatggggcaggaagagagattgtgtgggggttttctgttttggtttatcttgtaggatatatatctcaagctttcgtaagtggctgacaaaggctcaatcgagaattgtcatatgaagtgttgttttcagaagtttcataattcaggggaaaatccaaacccagtaggaaaacctactgcaaggcattgatttagtggcttgtctttgtgtgtgatggtcttaggggtaaaaagtatagcgggagatgggaaagccaagggcgcacgccctggagtcagatcacagttggctagtaaaaccatttatggaaccactgtatgtgaaatgctttgtatgacggcaaacccccggcatcttaaagacatgaaatacacacatgctcacacacactcgagtatgtgtgcacagaggcacacctcccctttcatgttaggaagctcggagagtgctaaaagaagtcacatttttgttcttcatgtatacacgcagtcaattccatagacaggccacagtggccacaattggcaccaaacacagtggtttcttgtactcaatcctctgcacatgtccctttctcttgacacccagtggaagtcattctctctcatgacatgccctgctcctcttgtgcatgtttagacattgttttagtgctgagaacatagagttaataatgacagtgaccaatcgatgagcataattaaaattacttctattaaagtatatatttatttaatcctagcactcaggaggcagaggcaggcggactctgtgagttcgaggacagcctggtcttcaagagctagttccaggacagcctctaaagccacaatatatatatttatttcatttagtttgagtgtgtgtgcgcgcgcgcgtgcgtgcgtgcgtgcgtgcgtgcgtgcgtgcgtgtgtgtgtgtgtgtgtgtgtgtgtgtgtgtacaatttagtgtagagattagaggacaacttgtgggagtctgttctctccttccaccgtgtgggtcctgtggattgaactcaggttgtcaggtgtggtaacaagtgccttaaccagatacaccacctcataggccctgaattcatttactatcaaatggctttaaacctgtttatatctaggatggtatcacttgggctcagaattatctaatacccttttctgatcttagtcccataggcccccagtgtcttcacggctttttttttttttttttttttttgtcttagtgtagcgtattgcttggacttttctgggcccttacactggtgcttgggcctcaggcaagctgataaattctagtttgcagggaggaagtagattattattgcaggcatctgtcctcatgtgaagacggacatgatttgttgggaaggttgtgaaggaaatgctgaaacatttacgtctttattaacaatttttgtcattgtttgagagggtttctccttatagggcaagggctggcaggagacttacatcatagcccaggctgtccttggacttgaggtcctcatgaagtggcaggttactctgaactcctcttcccctccagagccacaacctgcatgacagacaaaaatcagtttctcctttctttgagagacaatgcttgtaaaatgttcaacagatcaaagggttccttcttccttgctggggaatgatctgttgtaaaaatgttttggggctgagagttctttgtgacaagtgcctaaactcagtcaccagtttaagtaaaggaccctttttgtcctcctatgtatggtggtctgtaatttcctttagttcactaagacactcctgccttggcctcctgaatgctgctattacagccatgcccacccaccaaggaatttggcataaaataacttttaaaaaagtaaataagaatcttatttaaaaaataccctgatggtatcatggttacaaggctcatttaacatgaactgtgtgtttgcagacagtgtggatttaaagtttttatcgactctaaagtaatttctctcaaatatggaatataccagaaaaaaataaaactttcttctgtagatggagaggaagaacacaaggtggatgtggattttttttccctctgaactatttcctgtctgtgaactcagagtgggtaggaatggcaagcaggcccaatgtgggatgcaacagaaagtgcctggacacattcccccagagctggttgacttcctgttccgtcttgggctaagctcaatgcagcactgggtggctttaacagagtctcggctggctttgtaagactcagcaccgaaagcttctccccccaacaccacacactcaggaggcagagctcctttaatttatgggagcagttggcgcttttgaggggctggcattcccggcttcattctgcagtgccatgattggcttctgcttttctgagtcgcagtcataggctgatcagttccttcccttctcagcatagagccatcaagctaggtgtctgattccaagtggagacacagggacatatgttgaaggagagccactcgggtgcaggcatttctggttggcactcaaacccgtcaccatcacaggaagctcctggaagaggtctcagattgtctgcttttccaggagcccaacagacaccatctggagtatccagcgtctggcttctgtggttcagagtgtggcagctgtgacttcaaggccaccaaccagctctctcttccagttctgctgagcttggagagagatctcagggtgtggctggcaatttgctgataatttgctcttctagtcaatttctttcttatgcagctgatttttccttctttctcttttgcagtgtagcccatggcacgatggtaataaaaggcagtatttgttcattgtaacaatatgaatactcagggcgtgtgtcagtgttcttccgtgagatattattctgtgccaggtcataagttattgtggcttcagacatttctttgggatttgcagtatgctacttttcacagttgcctaacgtgttttttgatcaggtaccatgtattacgtgataccatcaatgtgaccaaatcttaaaatgacacaccgcttgaaaggaacaaatcttcaggaagtgtgttgaagattagtttgtctaatgggagtaaagcagaattgtggaaatgcaaatgatttggaaaccctcttataatgggagtgatcgatgagaccacgattccatcatggtcaatattgcaggcatatggtagtacttatgtgtggctagcatctatatgacaggcattaaataaagcttggagttgtaatccttaccaaagcctgtgagggagacaatggcctcccaaagaagtgtcctgggtttggggtacttagtctgccagttgtgtgactagctacagatcacttcgtctctggttacttctgtgtcaaagactctggccctggtacttgcctcctggagtcagggtgagaagcaaatgagttaatatgaaatgagcgtagagtaacttttaattgagattttcacaggtgttaaaatcctgtacacattattttatgttaagactggtgtgaagcaaagggtgtttggaaccctttttctttattgttgttgctcataaccatcactttttctttgctgtatttataaggggagttgtttagtcttggtttgacttatttatagtgtctggcaacattctttttatgcacttacaatgtgctagaaggaaacagaatactaaagacaaacattccatagtcatggtgggacattgtccatgtttacaggggagtagatgtctgcgattgtatttcattaactgatatgagctgtcctctttagagtttcaaacattcttgttattcttagattctgaaattattgacttaaaaaaattacacagctagccttgagctcctgatcctcttgcctctgcctcttgagtgctgggggtcactggcattgtgatgtccagcttagtttgaaatgttgatgcatttagggctatggctgaataaaatgtgggtggaaatccagtaacaaagacttgatacgtgagtttttaaaacagatgcctcaataaccttaggaaaatgtgcttcatggtatggatttatgaatttttcatgttttcacatcactcaatccacagtctatattctctctataagctgaggatgcatattgatttcaaaatcaccccaaggtactgaattcacaagaggcccaagcattacagatttgcctttaatgatttagcctgctcaactagtgctaaaatgtttaaaagaatgtgagtattgacttttaggggataaaggcaattaatacagcataattgaaaaaaattaaaacaaaatcagccagagctcagtggaagagagaactaatgtttgtgttttgtgttagagttcagcatgtccagatatattgtagtaactggtatcttggttcttgagtggtgtggagcatgttgtcaccaacagttaaatcttataatatatattttttccgttctgtgtattcagttccaagtgagttctctttgtggtggaatgtagctttggaaagaatgagtatctacaatatgcaatgatgaaaagctttgattggaaaaatgaccttacttggacagagccagcaaagactggagcttccccagtagctgcctcctcagttctctgcagctgtcaaggacaggtaaactgatgaggcatttgtatccaggcgctcaattatggttatagttggtggctcagaacagaacgtcttgagcgagaacactcattattgcattgcccgaattgtttatgaaaagtcaacaacaatgtggactgtgaagagtgtttggattttgttttgttttgccttttgttcttgggagaacaagttgtttctagatcttcctggagctgcagataaagaaaggagaggtggtgtgttttccccgctggcttccaatgtgcagcatgtctgttgggtcagttgctgacctctctggatctcagtctgatctccttcctttccttcctccctccctcattcctcctcgctatcctctctttcccccactctcttgttaatctttccctttctcttcttcacttttccctcccctccccttccctctcttctcttccctccaactcattcatttattcatttatttttgagacagaatctcactgtgtagaccaggttggtttcaaactcagtttttttgtttgtttgtttgttttttgccagagatgtctgagtgatgtcattacaagcgtgagataccacacctggtttcatacttgtgtttcatttacttagttatttgtacctgtgtgtgtgtgtgtgtgtgtgtgtgtgtgtgtgtgtgtgtgtgtatgtgtgggtatgtttttttgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctactgtgttcaatttgtcatttccccctcatttccttttctattctagacttctatactgcctgggtctttgaaacttaggtcaaatgtattgatggaaaatgtcaacattaaaaagattaacttctaaagattaaataccctgcctccagccctcatagttgtccttacagcgttggtcagatcactgattctttggaataatgcacatttattatacactcacagcaagcccgggtcttaaggatcatttacagaaaggattcgtgcggatttttatattgagcttggtttctggacacaatggccattgggtcggtgtgcatacttatttgcttttgcctttcaagaacttgctggcatctcgtttgattatttaaatgcgtggttttacttctcacttttagtacatttattattttatgtgtatatgcatgtgggtgcacaccatggcacccactcacgtgaggtcggactacagcttgtgggatactgttctcttcttctaccatgtatggagatggaactcatgttatcaagcttggcagcaacgctctgtaactcaccgaagtcttgccatctgtccttcctttcaaagactgctgttatttgagtattgcaatctacactcattctgcctttctatatccctctcagttcaattttatgtacaagatgagctgtgaccactatgtcctgattcattctcaataaagaaagtagttggcccagcctggactagcttctatggaggtaggaaatcatgcaaataaagggtgagaaacacaagggtagaattagaaagaacaccaaagaggtcaccttagcaacctgagaagtccggctctagctgagtctgttatgacgagacagtgagctgggaggtggtgtggtccctccaggctgaaagcacagtgtgggcagttcaggacagagatggaagaagtttccaggaggaagctagcactcaggcacctcaacccttcttagaccgagctgtgtgctgtgtgggcttgtctgatttagatttgtctccagtagagcctgagcacaagacttttagttttcagaatgtcctaacaatagttctagagtttttgaagcaatgactgaattttgtgtagctgtggaagcttaatatttccttttaaggttgtatcaagtatatatgtgtattatatttacataaaagcatcatttatttgttgacatagggccttaccatgtagctaaggctagtcttaaactcactaattagcttagactagcatcaaaattgaagtgattctcctgccctggtctgtaaatatggattcacttgttctcagagttttgtactttttgcagaatgttcacgtttaagagaagttatcaggatccttgggagaggaaatttttcctggtcctcagtaagagactactgtggttagttttaaaagtcaccttgtgacaacctaaaatcacctgagaagagaggtacttgcctagatcaaattggcctctgtgcatgtctttagggggttgtcttgattgttaattgaagtaagaagactcagctcaccctggtggcaccattccctaggcaagaagccctaaatggtgccagacaggagaaatctagatgcaggcagttagcaggcagtatgggtgtattcgtctcccgctgcttttcagtgtggctgtagctgcttctagtccctgccttgatttccttcagtgaggtactgtgattgtaagccctatagtcccttcctttctgtatgttgctttttgtcagactgtcagtcatagcaacagaaactataacagggacagagtatcatttattccacctgttcattgagttaaaccctctcaattcatggctgtcttccaaagagcatggtcgccagaacccaataggctgctaaccccttcctgttattcattcagtatatttaacttataattttgattcctggcttccacttaaagcccttattttctccttatgatcgttatgcctcggcagctgttgtatttcattctggaacagataattactttccaaagtggcagaaaagtgagtggttgtgtttttctggcttgattgatcaggagctctgtgatgcaatattgactgggttttccacagtgacagaggaagggcaccaatgtccagtggcagctgctacctgctggtagcttcctgtggccaagacaaatctgactgagtctttgtgtcagattctggctttcagaactcaaggttgaagcagtttaatggtcatgtaaggaaaatagtatgctgtcctgaaggaccccacagatgcaattttgtttttcaaagttctctctggaattttcttcctggctcacatgtaatcatggagtgccacagcaagctcagtggctcatggagcccagagtcacgaggaagtgatttaaaggagatttctcatttagcagcagtagaagtttattagctgatttctagagttcttcaagggaatgactggtggtggctattatagatggcatgctacctgctccttatatgaagatactcagtctcttccacaattggagctggcagaggatggattgcattcattgtttaatacccccggctttacttttcaatgtcttgggggtttggaattgttatccatcatctcctgtcattttaggtaaaaaggaaccagtggggaaatgtcttttacgtggcttgacccctcccccgactctatcaccaaacccttgggacatatgtcctcagtcctcaaatgaaagacagagtctcatgctagactcttcacgtggttgtgtcatttacaaaatctctgcctagttattctcactttgatagatcagcaaccagatgattccaggtgtttgaggctactgaatctcagacttaatctctagtatgactcccggattcatcactgttacatgtgaaccaagaaggtcccagggcccagagactgtgtaacttgcacaacagtgaacagctggaaagtggacagtcttggatttgaattcatacctgtttgttcacctgcccaggcttcttcagactgccaaagttagcagtatttttctgcaaacatttatgaacaacttcgagaaagacctaacatgggggaagggggtactcattgtgggtattgatctactgccaatgtttggctgcatagggacctaaacggcagccctctgagtggcagctctgttttcctcattagtgtcaaggtagctgaggaggtgagacttgtctattcaccataaagcaaagttttgggcgggacacttcacgtttttaaaagctctccagggcagtgttcactggccactcaggaacagatgaagcccagcctgctcttccttctgagcttggtgccagaaggtcattttgcccttctgtggaatctcaggagtggcattttctagtgatggatggtagggctcagggctgtctctctgtgcacatagaagtattccatgtgggcacaaaccatgcttcttgtcaccatgttacaccattcgtttgtaaagcaagatgacgaaaatgagaaaggctgtcgttctgtcactgagaaatttaaaatattaagaatatgagaaatagtatcatagattttcctgttgctatttaatcactttctccagtctctctctctctctctctctctctctctctcttctctccctctctccctctctctctcgctctctctctctctctatggaatcaagtagtagaggacagaaaggatctgcctcaccactgcattattctaggtcccttctcagctccttagggttggggaccgagtggggtttccataagaagatgctcgactgggctgcctcctcccgtcatcaaagcttcagtctctggtaaatctggtcctgcagtgaatctccagtaagaaatggatcagaggtgtgtgtggcccaggggaaagtgtgttctcagttcttgtctggtccttcaggctgtcatggacctcacagacatcttcctttgaatctttaataacctagagagacctaatttccggcaactgtaaatgacacaaagctgactcagatttaccttcatctctcctacttccagtcacctaagcacctgctgtacagtggctgcaaagtgttgctctccttgctctctaatgtcaaagccacaggagccagcagtgactctcagcaggactcaccctgccctatcagagttctcctgacacatgcagtcagccgtctccaagtctgccgatgtggttcctataccttcactggcattcagtcaacaccatctgggtgatgaggtcatagttttcttagtggatatgatatggaaatctaaaatagagtccctcctagacgatgtggagtgcgtgtgcgcatgcgtgcacacaaatgcacaaacgcatgcgtgcacacaaacacacacacacacacacacacacacacacacacacaatgaggcacagccacaggccaaggtttttatattcctctttagtttctgtaatgtggagcttttgttttcttgttttgctttgtagaacagaagttgtgacaggaaacccgttctctgtgatgaaagggagcctggggggctctgaggctgtgcaggctccttgtaaacacaacctgtggatcttttgaataagatcactcttgttattgctgttctttgtttctgttttgagtttgctttctgacagtgtttgacttccattataaggaccagcttcttccaggctaaaaatatctaaaggtttcagacaccgagtcatattccaaccatgtttccattcagccccagagtgaaggtgcctgcgtcagggaagcagagacccagcccaggacacccactcagaaggtgcatccttgtactgatgaggggtgctttgggaagctgtgacatttcccagaagaattcgcttagcacacatgtgcacgcattattaccatattctgtgtgcatgtgcgtgtattagcacatgtgcagaggccagaggtcaaccctggtgtcactgaatgactgaatctctcactggcctggaactcatctattaggctaggttggcgggctggagagccccagggatcctcctgtctctgccccctcagtccggggattgtatgtctgctaccatgcctggctttttttacataggttctggagtttgaactcaggtcctcctatttgcatcacaagtactttacctattgaactgtctccctggccagatagttctgttcggcctgtagaactgtcagtgtaacctgtgaccactgggttatttgcacctgtctgcatgctacagcagctcagagggtatgacaagtgtcagaaatacaggaaggaggatggcttggggtcaaaggcagaggtcagggtcatccatatgggaatgcttgcatctcccagggcccatcagagcacgcagctgttcttcaaggcagatgttccaaaagaaataaactgtctctgtgggcatcacatttgtgcttttttgcaggttaagagaaatacagaaattacaaagacaaaagcactattacgttaaggaaaggactggagtttgtatgttagcgtcacatgcttacatgtatacagcctgcacattttcatgtgtgtgggggtgctaatcagtgtacatgtgtgcatgtggagggcagaggtcaacctcagctgttctttctcaggtgctgtccatcttggttttcttttgagacagtctctctctgacctgggtcttgccaagaaggctcagctatctggcagtgagctccatggatcctcctatctccaccttcccagttctgggattaaaagcacagaatgtggttggttttatagagaagctgaactctctcaagccctaaggcctgaacagcaagcactttactgactgagccatcttccaaccctcaggctcactgtttaatggaggacctttttgtgagcctctcaagaaagcagatgctgcaacatggttttccggacactctgttctggagcagaatgaaaggacacaggatagcagtgctgtggaaggggcagagtctcatgcattcagagcagaagcaaagccattttccccagcaagtgttaggtgtaagtcttcaaaggaaaataagtaaacaactccagtgcattactgtgctacggaaactgtcatgaaaaaaaaaattgccttgggttgtcaaaatacaggaacagaaagttcccacatagaacaacagagcaagcagaacagtgttgaaaacaggtaacatgagagtgtggcacgctgagtgtggaattattgatggcacagaaactgagagggacaaagaagaatcaagaagaggctcttgagaaattcaagctcacagggaggcgtagagctagccagatcataaatgtgtctagttccatctagatgacaggggaggtgggatatactcagaatatggaaactcagaagagttgattcggggagaagaggagacatgctgtgtggagaagcagggaccttggctggacactgtggcctgcccatgccatgggaatagctggcttgatttgtgccaagcttcgtggtgagcatttccccgcttaatgcttaaaggttcccatttgagatggattcggtgcacgtcaagagaggaagccgtgaaggccacagttagggcagcattgaatcttgttcgatagaacctgcgtttggtgtctataggtggtttggtttcaggcccagctttcatccttgtgagcccatgtcttcctactgtgagagtttgctccagttcagtgactagccactgaaatgtgcctatattcctgatgtcccgttttttcctttctcatctgccttggtaccaccaccttagccacgttcaacgatccttatgtggtcactcctttaaacccgcccacccccatcttggcattagaaatgaacctcagagatgtgcctggcaagctccctaggcaaactctttgccactgagccacagcccagccctctgaagaccgtcctgtgaatgtgtttggctaagcactggtcttgttcagtttcctctcctcctaagatgaaccaaattattatgggcccctgcctgccttgtatttgtagcttgtaatatgtgtttcctttgtaggaaggaatttaacatctctgccgtgcatcccaacagtgcttaatgccacattgtacacaccgtttacacttttcatactcaattggctgacctcaagaagggaatattctaatccaaagatgtaatcacaacccacatcccagtttatggaaattggagtaaagttgcccacatttgtaatagagaaagagaaaggatcacgaggaaataatatctaaggaaaatggtatagtaagagaaagaatattctggaaccaaagagctgtgagcactctggaagaattggatcacttgtgtgtcagaaatctttaaccctgtaacagaggtggtaactatagcaacatgctttagagtaggctgtacctcaatgtaggtgtagagtgggctgtatctcagtgtgggtgtagagcagggtgtacctcagtgtgggtgtagggcagcattcttttcccttcttagctaatgtgcgcatattctttacaaactgatacttgtttagctagctcctttaagtaattgagagggaaaaataacattaaattcagggacgtttctatgttttgttatttggtagtatttgcagaagcaggagctgcccctacacattttattattttacttagttttatttcaagagcacagcatttactgagtactgcttttgttttatgcggttaaagtcctctttgttttaagacctttattcctccattccccacctttttttttttctgtgttaatgtctatactagtaagaaccagatcacacagagagaaaatcgctgcccaaaatagttttgttaatatattacaactaattgggcaaaacccctccaaattccaatctgtggtgttccacaaaaatatgtggtattcgagctggagtaatggtgcagcggttaagagtactggctgctttcccagaggacccaaatttggttcgactcactatcactcctgttccaggggatctgatggcttcttctggcctcaaagggcacagcacacatgtggtacacaaacatatccataggcaaacactgatatgtgtaaaataagaatatgtttttaaaaacatggtgtttgacctgtttagcgttgacagatgggcctctctaaaatcaggggctaaagagacccctgctcagcacccacaaatactaacagggaggtcagcatcctgaggccggctctcctgcttgaacaggaagtaaatggaacttccgactgtggtccctccccttttttgtactcaaagtggatttagtactaagttaactactaacatttctggaatctgagaaagattattagttactgggtttactgacttttattctcatcacaaagagtgagcggatgtggatccctttattgacacagggaaagaattaagttttcttattgctaataccactgtctctagtacacagagagcatttcctgtggtgtcccttctcaggggtgattatgaaggtacaatctttgcatgcttgtaggaaatctgactgggggcagagcaagagtgcaagaaaaatagaattgtctgtcttcaagccataggtaatacttagatgacatgttagattttcttcatctcaagcagaagtggaagactgacttcacaaagctgcaagccggcagtcttaagagactcataaatgcccctgcctcaatccatctgcctcctaatgagtgggctggtttccataaaatagattttttttggggggtggttttgagacagggtttctcttcggctttggaggttgtcctggaactcactcttgtagaccaggctggtctcgaactcgcagagtctgcctctgcctcccaagtgctggtattaaaggcatacaccaccactgcccggcaaaatagatttatttttaaggataaaaaattagctcgagccaggatgggtatgtggatgcgtgagtgtacgtgtgcgccggtgagcatgtgtgtgtgagcatgtgtacgtgtgtgtgcatgtgtgtgtgcatgtgtgatagttctgtgtaagcacacagtggtgctgctctgatagaaaagctgcaaactttacccttttgtgtttatcccaaatcttactttcccaggtaaaatctttccaaaattcttattattttttttttttttagaccagagtgagtcacttcacattgttggaatccacattgtgcttatttcagctgtgtccttcttccaggccaggagtcatatgggtggctcatcccctttccctccctccttgtcagcctgtcagttggacacacaccagctggttcttagtgcactgaggcaagctctctggacgtaggattaaagcataattttgttgagaaaaataaattgtatttagatacccagagggactggggtctgtgccaggcactttaagtctaggatatgaatttcacattgcaggtgctccctcatttccagtgccccccacttcttgagtgtatgaagagcatcctttaggggatgacgcttagtggataaatgatggcacatggtgtgtcatgggacaattatgtcactttcaaattaggacacttgcagaggatagttgtgaacacactattcacagggacgagtcctcaggccattaaaatggcaggcctgacattatccaccacggggaggaaaaagtcctgtgggttagccatcttgagaagtctttggtccacacactggccaggctaggaagggtttgggcattaggttccttggtctcccgccctcatagcctctgctctgtggccagggtcccccatcaggaatgaaactgtaagtaggaggtggggagggcactgatagacaccacacaggacagtatctgataacagggtgggaaacacctctgggtggccagtgagaagatcatgactatacagatgggcttctcagccaaccaaggatctcccacttgtatggggacgagggcatgagcagacattttcatgccgttaaacgataactgaaaattattgaggcagagcatggtgtgttatgcctagagtaccaacacttggggggctgaggcaagaggcgttctgagtttcattatgagaccatggttctccaatgctcccaaaaccaacagcaatagctgtgtcagcccaaatgaacacacagacgctatattaattatataactgttggccaatgacttgggcttcttattggctagctctgctttaattattaacccataactactaatctgtgtatttctacgtggtcttatcttaccgaagaacgcctgacttgcatcctctcttcccgggctcacatcgatactcctcctctgcctacctctcccagaattctcctcatctcctagccccgcctatcttcctgcttagccaattagtgttttattcgtcaactgataagagaaacatatacagtataacatctcccatcagtccccctcctccccatgttctaagcttggatgcccaccctaaggcctatgaccagcagtgtggccagtgctgccagctgcttctttctaggtcccaggcattgtttcttttgtcccttgattctcatgccctgtcatggctgagtaggtcactgggtccaaaaactgagcccagggctcacaatgacatgtggtagtgtcatttactttacactttggaatttcaagcccaaacgtaatactattatgaagacctctgacacctcaacaaagtttttttctcttaaagacctcctacagttagcaggagcagtagcaggaggctgacattagctgcaacagcaactatagaaggaaaactaaacaaacaaaaacccttcttacttaacatttgaaacagacatgggcatctgcctgccatgttcccaaacatcctacctatgatctggggctccttagccatatgcaaaacctcagcacctctcagaaaagcagtcaagggcattaccaatcctttcttcctttgcttgaaccgcacagcctctgtcaatcactggctaaatctttctttgcacgcactcgtgtgccattatgcaccatgtgacggtctctatgctgtgctttgacaggggggttaatggcactgaaacagctctctgtctaatcagaaccttgcagggggctctacccctgctgtgcccagcacatcctcctgcaaggttgtggagaaggttgctgactgtcttgttacccagtttgtagaattcattatcgcctaactgcatccatgctatacagaagtcacacggaccaagtatttggaagggatgatcttttcccagtacattgaccttgtgtgtggcatgtgtatgtacaagtatgtgtgcatgtgtgtgcgtatatatgtggagggtagtggttggagtcaagtaccttcttcattgatttccatcttaacttttagagacaatctctcattggaacttacttagacaacaagcctcagggaccctactgtcttcccccttccaggtcatgcccagttttttacacgagtactggaattgaactcaggtgtttgtgcttgacnnnnnnnnnnnnnnnnnnnnnnnnnnnnnnnnnntctccatctaaacaagtcaggatgactgtgctaagggtgttgtctttctgatttgtctgctctgtttataggagtgtttttcctacccacgggctattcttcccgaggctcacaagcgccatgtggcatgcccaggatttaacctggggtgggaatcctgaggtccttacgggataggtgagcagtgctgtcaggtttggttatgaggttggtgatgagtgtgggagaagacaggaaaaattccagaaacagcaggatggagtctgtgcttgattgccccctggaggggcaaggtctgtaggtacctctgcttattgtgtttgtcttggctttgtgccttacttatttcttggggaatgagaactctttattaaaaaatctaaggagacattgggcctgtgttacagctgagatggagtgaatccattactaacagtacacactatgagtcaatgtcccaagtattcttaagggtggctttaaaattaattgtttttgtattaaaaatttcaagtccagctattgcgggagatctagggtgctttccagaactctgcttccttccccaccctggttctctacagctctggctcaaaggcctcccaagggcaggctcaggtctctgggggggagggcagggaggttggggatgggtggtgtcccctacacctgcattgttttcagaggccagttggatgctcccagaacgccctgtatttttaaaattctgctcagactgagaacttggcagcatgttcacttgaactgtgaacttctggacttaggtgggtccctgtaaagttttatgtcttaaaaacactacaaaaagccaggatggaactttccttccagtgggcagcctgtcctgggagtcagaggcccttttctgatgtgtgtcccagaaggcaaagccaaagttttgagtttgaataatagacttaatagtcttaggttttaaatgacattgttttctcactggaagtcggtcccataatgactttcagatctatttttggaatcctgagtcctgtggctgatgacagatggctgtggagtagccaacacagccactatctttcctgaaatgataaaggctttattgctgaagcatcttgtctctatagatgtataattaattatgaacaagaaataaattgtatagctcgtggcatatttatttggtacagcattttataaacacgattattcactggtgtttctcagttctgcctttattacatgatgatctgataattcaggatgagaaatagctgcattaaggacttggcagagagttttattacaaattttagattattttgtaataaaatagtaccagtgatgtggcactttagctcacaatcatagtttcacacacacacacacacacacacacacacacacagtgtttttccataaaagttggatttcgagtaggaattttaaatgtttaaattgtttagtttttttttttgtttgtttgtttttttttgagacagggtttctctgcattactttggaggctgtcctggaacttgctcagtagaccaggctggcctcgaactcacagagatccacctgcctctgcctcctgagtgctgggattaaaggcgtgcaccaccaacacctggcttaaattattttttaaaataatgtattaaatgtccttccatggcaccctcctcctagaattgcagaggtggtagtgataccacatgctctcccagctgtgtgatactctgtataaggccatatagactggagagcacatctgtcactgtacagtccagggttttgctgtcacaaggagcatttttgcagccttcctttacatgtttgttgtgtgtgcacacagactaggatatgtacttttttcgtatgtaagtgagtggtgtgtgtgcagaggccagaggaggacactgggtatctcttactctaccttcttcctttgagacagggtctctcactgaacccgtagctaggctgccagccagaaggtcccagcaatgttctgtctctgctttaccgtctgcagccatgcctgacttgttatgtgggtcctgggatctgagtttgagtcctcatgatgcaaggatagcactccactgactgagccatccttccagcctctgactgactccttttcaaaggtctcgttttggtttttcacctttgtacatgttcttcaaaggtgagatgtgtgtagattctttttgtttgttgtgcttggggtgtatcatgaacttgaggaatttcccatctggaaattcaatacagttatgctttggtgtttcctctgaggcttctttttttttttttctggtttttctttgtggggcctcctgttaaatttgctaaactttcttactattcccttatttctacttctcctgctctcacatctaatctttttgtctgtttttattttattctgggtgatagaagcatgcctgattccacttaatcacttctctcatctttctttgtctagttcataaatctgccccgtggagttttatgcttcagtggcataccccttatctttattgtttattatttttagaagccttcattgttttattcagatctacttagactttttatatgatttttcttttcatgctttttgtgtgtgtggcaattctttaaacactatagagggagaagatgtgaattatagaaaagcacgcacgctgacctgtctggcaccatgttaactggggaaacacacacacacaaaaaccccaagagtcctgttgtcctagcttctgggaggggaggggggtcaggaagaacccaagttccaggccatcctgaaaaacttagggagcccttgcctcaagataaagtaatagaaaacaacaacttccaatgtggcctgtggattatagtctaggatcctgcataactttgtttttgaaagacagggtttcactatgttccttggctagcctggaactcataacgatcctcctgcctctgcctccacacctgggttttgcataacctttaaaggcatgaggagacagtgtgtaaaccaagctgtggaaagtttaagctgtgaagctggagtaatacagtttcccagcaggatcggcacatgggtccaaacattgcagcagtgtggtatatatgtccacacttcacgcttcatgtctcactcatcatctgggttccatctcctccatgttgtgtgtatgtatggcttcagtgctgccaaggtgctttgcatctgcatagtggactctggatgtttattagacagctcagacaattctggcttccctgccccgtggattcctctaggcccctttctgtggctttttgtgcaactgcagatgtgatggtgtgttacataggcttcccatcacaaatactggaggacacagtcgtgagcagggaaacctgtttgtgctcatggtctcagaggcctcagctgtggccagccggctccactatttttaggcctatggcaagagataaacattacagagaaagggcatggcagaggaaactgtgtggtatcaggaagcaaagaggagtaacaacatccggcagaagatacacacttcacaggtgcctgcaggtaccaccttccgcaccgactcagttctgttcagacctcaagtacattactagataaacctcacatcacatctagtcctgtctggaaatggcacgtgggagggcaaggcaaaaggactggtgcaggttcaaggccaggctgagctacacagtgaggcttgtcttaaaaaaaataaaatctgcaagtaagttagcacgcttttcaaattgccactcgagccatagtgagaacctgatggggttgttaggaggttgtgtgtgtgacacactgaggagagttgccctgtaacaaatactttgtggatttttattattactctagccatgcttattgaaagtgaacagtcatggatgtgttttcttatgaggtgaatgcataataaaaatcaacctatgtgtcagtggtgaatattatttgttgttgggatgaatctgggtccaggcacgggctacgtggctgtgttgaggcttctctcacaaaggggacagatagggagacactgatagtagcatttttcttgtggctgtgctgcccctgtctcccaggctactctagggtcgggaaacacattccatggtccaccagtcatcactgtttcctgcttgctaggcctgcctgcccacactgcctggcaggccaccctctatttgctgtcttcaccccaggcctcagaaggactatctagcctctgcttctaagtaatggttcctaaggcaatgaccttcatttcctgagtttggggggatgccaataggcaacttgggtgtggtaagctgtaacaggcttaggcagcttcatctaaggccccgctgcacacagggacatggctgagccctccgtggctctcccatacaggggctggtgagtgccgggctctataccatagtctgagtgcccatcctgaacccactagaggtcttctggaaccttctaaagttcttgcgatcagaattgggggtttgcagaaaggacccttttggagtcacatgtcagccttctgaagcttatctcccagcagcccggctggcacttctcactcacatgagctccttagaaacagctggcagtcccggggccactggggtggggtggaggttcgtaagcagccttccctgtgtgcctgggtacccagcaggcaggcctggcccaagaatacatctaatgaggcaataaaaacaaaattaagttaaaatcacctaggaaaaatgggtttgtctgtgagcatgactgttggagattatttctgttagactattgaggcagatggctccactccctaggcaggagatcctggcttgtgtaaaatggagaaatgaatggatattgagttggtgtgtatctttttctgactgtggatgtcatgtgaccagcgtgttcaagctccagccactgtggctttcactgtgatgaactgtaacctgtagcggtgagctaatcccccaaagcagaagcctcccatttaaagtttccgctgacacagtattttatcacagaaagacagcaatgctgtctgttgtagtcataagccgaactggttacacctttcagcattgttcttgttagacgtgtcagaaaaacggtcttgtgtggctatgatacaatgccacaggctgggtagtttatgaagcacagcagggtgttctccctactgaaaatggaagcattcacaggttaggtctctgtttctgtttctacctggcacctcgaacacagctgtctggagaggaactgtggtacacccttctatatccagagagcaacacagagagagccaggccatccatgaagcgtccatcctatgcttcaaataacccccactcacccacactccttaacactgcagcatgagtgcctaagtctgaagcttgtgacttccgaggaggggggcagcaaagtcaagctgtaccaatgtggatggatattcatgatcggcattttctctaagtgagcaatgcagttggcagtcgtaggaagacagcttacagtgttgtgtgtggtgttgaggctcagaatttccaacaagaaaagtgggcttttggaaactgtccagctgtatatactggcaatgaaaagtaggaccctgggtaaatgggaagagagggagaagccggagaggaagacagggcggtgtaggggaagtccactcataatttgtggggctggcaagtttggagtgatccctgcctgaggattgggcagtggggcagggttttttcttgagaggcaagattcctttttgagtggcccaagttttctcctaaggccttaattgctagataaggcccaccattcgccagtgaccctaatgtgttagtcagatattgaaagtccttggttttggcattggaacatgaaaggtggtgccctccatactggtgcaatcagagagtatggtaccgagttagaacttagtagagatgtgtttgctttaataaaccgttttttactttcagaagataacccccccttttaaaaaaccttttaacaatagtaacttttctatttccttaaaaacaacctacatagggctcagggaggttagactaaaaatgtctgaggtcacagtggttggtgatagacgctgatctctgtacgttcgggtttctgtctcatagttcctgagagacccctgaaataggagcctagtttggtgactgcagagaaaaatcagccacagactgattggtgcaaactgattggcaggcagagggagttccaggagccagggacttacaagggactgctgtgtccttgcaggcctggagggttcctgctgaccttggcaatgtggtgcaggctctggggttaaggacattcagttcgaagccatctggctttgtgtcggcttctggttacaaagtggtagtggaaataagggaacacagaggaacatgacagaccctgaattccatgcattggagacctgtctgctagcaaggtcataaagtgcattgctgtggacgccttctctgtggcatctttcccttttgtcatttaaccctttcgctgggggcagtccctcgacacgacttttcttctctgtgatgaggagaggggagtttggccacagaggaagggaagtgtttggccggtgttggttcacggtctgagagcacagtaggtcatagcagggaagtcactgcagccagagcgtgaggcagctggtcagtctgtggaagtgaccagttaggaagcagagagacagatgaatgctggcactgagcccaccttttccttttttttattcagccaggaaacccagcctatggatggtgccacccacatccaggggtggtttttctctccttggttaaaacttttgggaaactccctcccagacctgcccagagctgtctcctaagtgattctaaatccagtcaagttgacaatgagtattaatgaaccagtcttacaggttagcagaacaagtcaggcaaagtcagtctttagtagaatttgtgtagtgcaaaggcgttgtgaaggcagggagctctgggcacactctgcatttgcacatccagaaaagtgtcttccagctgagtggtcacagcactgtgtgcacccaattcctgcaatgaagagatgggaggagacaaaaaagctctgggacaatggggatttatacttttttttcttgtcgagtttttgttccctttcttttgaataactgttagaaaattcttgctcatttttttttttttaaatctgagcagcaacttgtatgtacctatcattctagctcctgtgggagtggggcaggggaggtaggaagaatacaagttccagtccagcctggacagattagggagcccttgtttcaagataaagaagtagaaaacaagaaccaagtattgcttggtagcagagcacttgcaaagcatgtgtgaggccctatactcactcttcattattatcattgttagttttggtgcagacacttgaacccgagtccttgcaccttctcagcaggcaaacactctatcaatgagccccatccccaggccctgaatgtctacaaatttcaatttatttatttaatggaaatgtatttttatacttttgttttgttttgttttgttgagacagggtttctctgtggcttggattctgacctggaactagctcttgcagaccagactggtctcaaactcacagagatccgcctgcctctgcctcccgtgtgctgggctaaaaggcgtgcgccaccactgcctagcttattttctttcttatttgtgtcttggtgtgagagtcttttcttgctttgttttcctttccaccctcctgactatattatttatttcaaattccaaggccccagatattgctggaaagttgtttacatgctctatcatgacctgggtgtggtggtttatgcctgcaatacaaatacctgggaagctgaagcaagaggatctcctgggctacagagtgagaccccattctcaacatgtttatcctccctaagaataaaaataaaaaataaaactcataggctattacactcacacacacacacacacacacacacacacacacacacacacacacgtccttgaaatatttctacaaaaaaaatgaggctaagaagatgaatgtctggtaattcgaagtcagagttggcagcatcattatgtgaatttaagtattaggactaaggcacccaggtcctcaaagctactctgcccagttgtctcccaccattgaaacatctctaccatactttcttcatgtttgcattatgtgcatgcgtgtgtgtgtgtgtgtgtgtgtgtgtgtgtgtgtgtgtgtgtgtgtgtgtgaagccactgtgagggagcccctaggccagtacttctcgatcatcctaaagctgcaatcctgaaacacagttcctcatgttgtggagacccccacccaaccataaaattatttttgttacttcataactgtaattttgttactgctatgaaacatattataaatactattgaagaaagaggtttgtcaaaggggtcgcaacccacaagtgagaaccactgccctggggtgtgaaaactagctacaagctcactggatcggccatgaagctcatggtgaccaccctcaccggttgaataattgatgtgtctcacatatcatatgtctccctggtccccagaaagtattgaagagccagctgccaccacctccaggaatggagactccagagccaaggggttaccctggcctgtattctttgatgactggtgtcctttggtcctttaagtaaccttgcccttaccacggtccaggtgtcttgttgggttacattttatacaggaagcatctgggattcaagaaagtgtgatgccctaagccagtcacctgtgtgccagtcattctttccacacagacctggagagcgctgctctattctctggattcaggaagcaaggatcagagagttgaaggacctaggccacggcacacaggaactgtggtgtgcttatgactttttttactctggggctattggccaggttccagtgaaacacttccatagtaagaataggtggcgccgagtatccagtgagcaggacagggctgcagaacagtttggggaaggctctttctactctgtagcatgtgggaggccttccactggcccaggtcttactctctgctttctggttctgcaacataaagccagtgagtcagaacccaagtgatgggggttgtccttctgtacatatgtttctcttattggttaatgaataaaacactgattggctgattggccaggcaggaagtataggcagagctaaaagatgaggagaattctgggaaacataggcagatggagttgtcatgcagagcctgggaagagaggacgctcaaggtgttccccagtaagccaaggccacgtggaaatatatagattaatagaaattggttaataattaaggcagagccagccaataagaagccctagtcatcggctagcagtttcataattaatatagtatgtgtgtgtttacttggggctcaagagctgtgggaccaaccgggacagaaagctcacattacacccaagggcctgcagagggtcttcttttcagtgataagaaagacaagatttggccaaagttgctgggccatgagtcaaggtgggtgtgaaaacattgtctgacagaaagagctcctactgggcccttctggacagggcaggggctgttgaggcccccgactgttactttgcctcttcctgcccagcagctgctctgtagagagtggaggggacacacgggagctcaacagggcctctctatgtgattctttctcccaagtgtcggggtggctgcaaagcagagagctccaggtagaaacagccaaagcctgaagggtggggatccctgagcgatggaagatgaagcagagtaaggatagggcatgaagtggagactatccaccccctgcaggcagcggatgctgacttccaggaggcagagtccaggacagcaagaggatgagtggagacgtgattgaaaagatagagagatggattaagtgggttctgagccgtttttccctcattggacgcacttgctcatatgcaaattgcgaagttcagagttgaagaaagcaggaatcggtaattgagacgctaaaaagctaagctctgagctcctgccattgtattagggtatttttattgttgtttttctgacagaatacctgccaggaacagcttgggggtgggggattaggtttactgtgggctcatggtttcagagtgtatcggttcatggcggtgggcaaagcgtggcagccagagtgactccgtccacggtggcgggagtggtggcacagcactgtcataccctgatgggttgggatgcaaagttcaggctagaagcagatgcaatcaaagcccacaggaagccccgaggcttctgggaaaggtgtggagagagagaaacagtttccatatcaaggtcacaaagcttcatcttttcttcctccttttctccgcagacgtttgtcatcctctgtacctatttggagatgtcctttaagttcccatccctggtgacagcctgggaaacacaaaagctctaattaaagactgtcctgagccacactttctggaggagcgcggccaagcagtggccccataacctgcaccaagacctttttttcgggtcctccaggggtgcgctcaggctggggcttaagccctgatctctttttcgtgggggagagcattgttcatcccaggcctgattaacgtctcaagccgcgttttcaactttgcttggggttaagaggtagacggacccgcttaccacaaggaagacaatacaggcacaactgcatctcatgaaccacactcatgtgccacacagagatatccagagcagagacctagacgtgtctccaacgggctggtttgccccagctgccccgagacagctacctgctccttagtctctgggatctgctcagaactaggcagggtcctctctgccaccctcccgtcaacacagagggcccagcaaaggggggagatgatgaacataagaaagagaactctcaagtggctcactttcttcctgctcctcgtcttcctcacatcctttgtcttgaactactcaagcaccggggtgcccactgcctggttctccaagcacatggtcctgggattctcggacaacttacgcaagctcatcaagtcacagccctgcacctgtacacgctgcatcagccagggcaaggtctcatactggttcgaccagcgtttcaacaagaccatgcagccgctgctgacagcccacaacgctctgatggaagaggacacgtaccagtggtggctggtgagcagagtaggggctggcaagggtgagaggaggcaaatgctaggtctggggggacccaagggcccaccaatcatctggcagcatccagggtgtcatttctttcagtcagcaactgtttattgagcaactattatgtgtaagtcagagaaaaaccctactgctttccctcctgtggctcccatgacaaatcaccacctggtgggttaagacatcagaagggatcacatggcacagtcctggaggccaagggatttttacccccatggctttttcctactgctgcagctgaccatttgtggtacccacatctgcaggatccaacctctgctcccatgttgcatggttttcctgtgtctttggtgtcctctcctgggaagggcgcgtggccttggctctagggtacactctgagtctatgttcatctgccctgccaccagtagcaaaactagatcttagcaggtgttgggaatgagaaatgcagtcattattgctgtcctgggtgtctagggattggcccttgtaactgaaggtcagctaaagccctagtctcgtacacagtaggtacccagagagtacctgtagaatggatacatgagctttctccctgtctcctgtcttggggtgggggtggctatcactaaccgcctgtgccttcactgttagtagctgggtttggtagcatcggagccaagctgaccacccatcccctctgtcctccgccccagaggctccaacgggagaggaaacctaacaacttgagtgacaccatcaaggaactgtttcgcgtggtgcccgggagggtgggcctggtgctgggcaagcggttggtgggttgccgacgctgtgcagtcgtgggaaactctgggaacctgaaggactcctcgtatgggcctgagattgacagccacgacttcgtggtgaggtgagcactggacccttaacccaagcctagggatcctcagaggtgcgtgaaacaccttggctcagctcagaaggacacggttccagggccccaggagtgactgacctctgggtctcagttcccccatcatgcaatgagaaagccttggctgggcgggaatttccaatgggctggtgacttagtacctaaggcgtagctattgggtgggcaacactgatttgaagcctgtgcttctgtggctcaaatctacccccacccctaccccaccccggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggatggataaatggatggataaatggatggatgggtagatgatggatggatggcttcatgtccatagaccccttccctggctctcagtatacctagtatcagtgggaatgcccacaatgagaggccaagtcatgttggggtcaggctgacttcagttcaaaggtgtatcttggtagacagctcatctgggttctggatcataaaaaaggttcacctggtaggtgcaatcacacaggtggtcagttactagagggcaagacccacccccacttgcatttatttaaaaaacaaaaataaaaacaaaaccaggggctggagagttaatgaagcaattaagagcactggctgctcttccagagggcctgagttcaattcccagaaaccacagggtggctcacaaccgtccgtaatgagatctggtgccctctctggcagcaggcgtacatgcaggccgaacactatatataataaataactaaatctttttaaaaggccaacaaacaaaatagccttggtggcctctgttttgctgaactagggatagaacttggattcgtgcatgctaggcaagctgtctccccttgagtttctcaggctggacttgaatttgccatcctcctggctcaacctcagtagcggggttttcagacctgctctactgtgcttgtgtggcctgtgtctagagtgtccccattgttcacatggggaaactgaggcctagggaacgaagaggctcacctgtggttatcattcagtggactccagctgcagcattcttaccaagtgctctgttttcctctcctcccaggatgaacagggcacccacggtgggctttgaggcagatgttgggagcaagaccacccaccatcttgtgtatcccgagagcttccgggagctgggagataatgtcagcatggtcttatcttattgagaatgccagactcatgtatcctctgtttatttttttttgttttttttgtttgcctgtttgcctgtttgttttctaaagagagagaaagtgtgtgtgtgtggagttggatggatgaggaagtgaggaggagttgggggaggagaaagtgtaatcagaatatattgtaaaaattttaattgaaaaactattttcagttaaggaagaagggaaggagggagggagggagggagggagggaagaaggaaggaagaaaggaaggaaggaaggaaggaaggaaggaaggaaggaaggaaggaagggggaaacctagcaaggggatagcaacaggagggcagggtgtaccagggcaagtgagattctgagttgattgctgcccctctggagagttaatggccctccttttcctggtgcacagagggagacacacttgtaaatggagatttctttgtggatgcatggtttcccttacagaagggttatttctcttctgttttcaaagctttttctgtgtctgcagtttctcagaatagctagctcaaaataaaccttatcctaggaagcatattttggggtaacatatgctagtctaagaatactagcaatagataactagaaaaaaaagcaacccattctgagcttgctcaagaataggcctagacccttggggtttgaggaggcccggggaggaacggggcaaacacttcccacagcagcctgtcagcaatgctgcccctgcgtctcctccctggggtggacagttcctaagctagcaatacttgtcttgccctgacctttcttctaccagcaggcttcatttactaaagaacttcttttcccaaacaatcaatcaccttcagtttggttagcctttccttgcacagaatagttgtcagtcttattattttgcataaaaccatcactcttcccttgtgggtggctttctgctcatgtagcctagtgatctgcccttcaagagcagaaactgtattgttagaaaagtttccccaatgcagaggacatgagggagaagaaaggttgagtcaggggaagaatagaagataacaagaatggagctgggtggtggtggcgcatgcctttaatcccagcacacgagaggcagaggcaggtggatctctgtgagttcaagccggtgacttcttttccaagatgtggtgttgtgatggtggcacagagctacacagagtacccagtccctggcacttgtgaagcctcactgataaggacgagtcctcaaagtgggtctccagaacagccccaccacctgggaacttgccacaggtgtgactcttcaggagtacccaaacctgctacagctggcccagggtagaccagctctcacaagcccctgaagggtagggcatgtgtaggctgcagttttgttttgtttgttttgatttgaactattcctgggagcttcccaaagccatactcacctctttctctccacacctctgtccttgataccataatagagggagacacttttggtttacagagaaatcaggcactagggaaatgtctgtagatctacaaagatgacaccagctaacaatctaagcaacagaggagaggcttccttatatgccctcccctgataatgagattgatgactgacttatatgccacccgatagccctcatccagcagctggtggaagtagaagcagacacccacaactaatcactgaactgaactggaatccagttacagagaaggacgagtgaagagcaaaagggtccagaccaagatggtgaaacccacaggaacagttgacctgaacatcggggagctcttgctccccagactgatagctggaataccagcatgggactgatccagaccccaggaacatggctttcagtgaggaaacctcagaaatctacaggacctcctatagtagttcagtacttatccctagcataggtgtggactttgggagcccaatccacatagaggaatactccctgagccaagacacatgggggtgggcctaggccctatcccaatggataccatagactctgatgacaccctatggaaggcctcaccctccagggagaagcataaaggatatgtgataggtagggttttagatgtggggtgggggatggtagaggaggaggggagggagagggaactgggattgttgtgcaaaacaatcttgtttctaattcaaattaaaaaagagagagagagagaaaagaaaagtttcccaaaatctgcaaaagggacgccagctcttaggagctgttcttcacccatactctgtcatatcgcagagttgttcatgacatctttaaccttcttattcttctgtttttacccccaagatagggtttctctgtgtaacagccctggctgtcctagaactcactctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaaaaaaaaaaaaaaaaaaaaaaatctctcccttccaggaggcaaaccggagcattggcagtccagtcttcggcctgctactctgccctgcagagaaacaattatcaacatcctcagtcacatgaccgaaatccttacaatttagtcacttctgtgcatatgcatgctgtgtgccctcctcttctctggaggactctggctgatacataggtcatttattaaggtttttactttagatactgaggttggagttgggcttcacacatggtatgtgtaacataaactttagaaactaaaagcatgtgttgattattctgtgctgcgtgcacgcaaagatgatccgtagtccgtaaggctaagatttctttattcagataaacaccagcccaaacgcaagccagagcgtgcccagagctcccaagctagagtggccagagaggagaggctatccacttttgtgctgtcccttgacctcctctgatcacgcccgtgagggcgtggccaggcatacctgtaggggctactaggaggccgggctactaggaggcggggctacagtgtctccctacaagcatggcctgataaagcactaataagctttcattttaaaatacttctgtcagaaatcaaaaccagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccccccccccttttttcccctagactttacaaaaatgctctaagcaccttgaggatgaattggtttctgttgttgttgtttttgtttgttttacaatgatagttagactgaaagggcttggcactttcaaatgctacttaggatttcattcctgtcactgactggaacatccaaatcgggtcagcagagacaagcagaggtgtggactagatgctgagggtgaggatgtgctcaaataaatacagggcttggttaaccattcggtgttccaccccataatcaatatgttatgaacacagtgcggatgagccgttaagcatccacacagcataatcccactccccacagtggatgagcaaagagtctagagcgtgggttccctgcagaccataggacacagaagaggccacgcaattctagaaggctcagcaagtctagaaggtaaccgttattcatttcccagtgtccctgcaaccatcctgacaaaggggggagcctggcccaggaggtggctcagtgatggcagagctgtgcgagcattgggacaggagttcagatcccgaggacccacttgcaggctgggtgtgcttggcggttttctgtaattccagcctcgggaagctgatacctgatcctcagagcaaacgggctggaaaggctagccggatcggcgagctctgggtttgactgagtggcccctgccttgatgaagattgggtaattccagactccaaccgcaggcttccacgcgcatgcgcacaagcgtgctaacatttgcacggaaaccaaaccaaaccaaaacccccaagctgtacacacatgcatacctagaagagaaaaaataaaagcctgtgattctcagtctcctggtccgtgcagtttctgaagctttgaagttcacgcctttgacctctgtggctgaagcagcggaatggaatctccgcctttgacctctcgggaggctgaagcagggggatctccgagttagacgccggccagcctggtctgcacagcggaccctccctgcggaccattcggagcccagagccacgctctgtgtgcgtcgcttgagaagagataccctcaggacccaggctggagtgcggaataactgttctctaatttaattgaagcttgactgtccctgttctgggacagacagacagacgacagacagctccacgtttgtttaccgccagttttggggactgcctgctaatcagtccctggtatcccgttagggttctttctagtgcccgagagcccagaaagatcatcatcctacagatgaatgaagtacatttacacaagcactttaagtgcattttaattgtaaaaataaagatgtgcatgagatgggatgtttccattctagcctgctgttttggtttgtttgttttttcaatgcgggcagttgaacctaggatcttgcccgtgctaggcgggtgctctaagaaatggacctacatgttcagtccctactaattctaaagtgtcatttataagctagagatgtggctgtgttggtaacatgcttgtctagagttggggaagcccagggttcaatcctcagtaccacacaaacctggcttgtaataagctcattctagcactgaggacacgagacaagcagttcggggctatctttggctgcacagaaaatttaaaaccttccgggactagagatcgctctgtgattaagagaaacactgctctttgccggagattgttctcagcactcagtcagatccggtagctcacctctgcttataaccccaacttgaggggtctccacctctgtggaacttccaacctctgtgggcactgctcccacacagatttataaaacttctcatctttggatgtgtgtggcaaaactgtcctggaaatgttgtttgagcaggcaaaatggcaaaattggagaactatttaacttttctggctcactggcattgaagtactgggaaataaattattttcattttacctctaagctgcggttatgaagacaaccgagttctcttataattagtttctttgcaagccttgcttcagtgttagtttccttgttttagatttgctgtttccgtaaacttggggttttctaaaagagaaaattatagccgcacttggttttaaagaaacaccctggcaatagaaagcttgacttagtgctcatgtcataatacacttggccacaggttcctaagttaggggtgacatttcagtatattctctaaattatttcccttgggggttagaataacattcccatttttttgtttttgtttgtctgtttttgttttccgagacagggtttctctatgtgtagtcctggccaaataatcccatttttataccttgttaactttccgagttcttttatttcccgattctttggggaggagatgactgacgtctaaagtttctactgatttttatcgacctctggtcattcagtcccaatcctggaatactaaaggaataacgaaacaacattggttcagttgtcagcaagggtaaccaaaccctgcttgtacccatctttttcaaaatgaggtgaccatacatcagggtggttccctgcactccccctatgacgaggcatttcggcaagggggggggggggaaaccaaaccacagacaaccagaatgaagtttgcttcctttttttttttttttttaattcaacatgctttctaaaactggaaggataaaggaatacaggtgggccagaatgaagctggcttcctcttttaaaactcaacattgctgtcctaaagtaaaactccaagtagaaacgaatacaaacggcctctcccccccccacgccccatgtccctccgcgtccgcttcacccgctctgcttggccgccagcctcttgtctctctcttcggcgatggtcaggcggatccccttcccccgcggcagcgagatccacggcttgttgcccttgccgatcacgaagatgttggagaggcgggtggcgaagccgttcccgttggcgtccttcacgtggaccacgtcgaaggagccggggtggcgctcccggttggtgatgacgccgatgcgccccaggttggcgcctccggtcaccatgcagaggttgccggtgtcgaacttgatggcgtcggtgatcttgcccgtgtccagcgagatctgcacggtgtcgttgaccttgatgagcgggtcggggtagcggatggtgcgcgcgtcgtgcgtcaccaggtgcgggatgcccttggtgcccacgaagaccttccgcaccttgcagagcttgtacttggcctcctcgggcgtgatgcggtgcacggcgaagcggcccttggtgtcgtacaccaggcggaagttctccccgctcttgtcgatgctgatgacgtccatgaagcccgccgggtaggccacgtcggtccgcaccttgccgtcaaccttgatgaggcgctgcatgcagatcttcttcacctcgtcgcccgtcagcgcgtacttgaggcggttgcgcaggaagatggcgagcggcaggcactcccgcaggcggtgcgggcccgaggacggccggggcgcgaacacgcccgtcagtttgtccagcatccagtgacgcggggcggccacacgcttcaggtgcttcttcggaccgcgggccatggcggggcggcggcagcgagggcgagcgagagggcgagcaggcgggagcaggcccttctcctaacccagagcacaagtcgaatgaggcgggcggctgcgcgcgcagtggctggaaaccccgcccatctgggtcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggaaaataccaagataagtatgcgataagctatcttccttctggaagagtgcagcctgcattacagggaaaagtaagatcaacaaaacttgcttggatactttttgtttgtttgttttttgtttttccagacagggtttctctgtagccctgactgttctgcagctctgtagtccaggctggcctcctcgaactcacagagatcctcctgcctctgcctcccgagtgctgggattaaaggcctgcgccacgattcccaggccttgaatacgtatcttgtactattctttatattctttttatttttttattttttgagtctgttagtgtgtaaatcagaggatggcttttttcccccaccatgtgaggcccgagaattgcacgtaaactcctgggccatcagcatcaggtacatgaggatcagagggtgagtttattgtctaacccgctgcagcttctgaatgggtacagtgctcaggtaacaccaggcaaggactatacaggcctaggaggcaagaaacttccaggcaagttcaccttgcctcaaaggatgctgagcaaaatggagccggcatcaacacccatcatgcatggtatttcacttttaggtcttgaacctccatcttggcatccttacattctgattttaggcttagctttgagacactttcaggagtgtacccagtgctgtctagcagagagccagcagggagcttgctgttgctcatcctcgaccctgaactgttgtccaggcacttctcttggcccctcactgtccacactcttacgttttcagtgtctctccggcctcaccgtccacactcttacgttttcagtatctctccagcctttggccaagcatcgtttctcctttgtagtttcttttcctttcccacgtcatgtcaacaccttctctgatctgtagcccttcatcttttgttgccttcctggggcagggtggagaggagccagtgcacagactcacatcctgattctgctgatgactggttcactttttaatgccttggtttccctagtaccacttgattcctaattacatgaaggtagaaaaagagttgaagtgtttggagcagtttctggcccctgctgtgcgctcagcaaacatgagctgttatttaaatgttagattatgcatttattcctttcatgtaatacttctagggcctggctctgttcctggaacttttcctgtcaaattgaatatcgttatgtgagtaacttgtcacttttcatagcggtgaagttgtagtaggtgttctcctcatttcccgaattgatcaggttgtgttgggaagccctgagcttgaatctgtctcagcatgtgtccctgatctgtttgtgatctagaggatgtatctcaacttcagacgtcttagggatatggagacggctttgctgacagtgattggagaggagaaaaatgtgtgcattgaaggcacagacttgtgttctacctcccatctcttacttcctgtcagaccttaggacaaagtacggggccattaatgccacaatttcccctcttgcaaaagggaaatattaatagtgtccatgtagtgggcacgtgatcagggtcacgtgtaacagcctaggatacacagtaggcagtcactaaatggtaacctaaagttaccacccactgtatactgggacccggggcctcttcaagaccaaaacatgctcttaattactgttgggtgtctgcaggcccaaacaaaaggtccatgctttttagtaagaacagcccctgatcctgtcacagcaaggggaacatggagagaacatgggagcacacagtacagtgactgacacctgtcaagtgcacttgtggggctgtgactgaaagacaaggctgacatcaccacgatgacatcattccttgtagaaataattaaaaaccaggggtgctgactaaattaattgtggagggaaagtaaaatggttcctctgactaaattaatgaagcctgatttcattgacttttgacatagaaggaccatgactttctccaagtcagtttacgtttcttggcacacgtgtgtgtgtgtgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaaaaaaaaacacgaacgcacacgcgcgcacaccccacacacacacacacacacacacacacacacacacacacacacacctgtacccctccagactctctaaagcccattcagggacagccactgtgcaccctgctatggcagctgcagtgaccctggcctggcctcatgccaaacactctgctgtggtttcagaagggaagaaaggacacagagaagctctggaagatggacctacccagaacttgttagcagcaagctttattttctctaattagccagttctgagcatggaccacttccagagattcttatgagccagaaagaggacgagacctgcttttgagtaaagctgtcgcttctctgcagttccaaagcacttcctacactacaggggcctcacacctccagtgggcagactcaaggtggacctatctctgccggacactagcccactcaagtttactgaagaggcactgtctggaccaaagtttctctccagtgaaaagccctcattcagtggcagatcttaagagagaaattctttgagggaagaaacagatgaaagggagtgaaagagctaaatgaaaagggttagggaaaataaggaggaggggaatgcccagggattatgtgatttcagttcaacttcttttctccgctttgactgaagtgtgcaagccttcatggaggataatatggaccctctatgtttgcacagggggcctgtcaacctcagctcttgcttctaggtcacagaagccagccagtcccattcacaaagctgcaactcctcctactttgaaccagtggcaacgatggtggatgcagggtccccattaatctctgacacctgcccccccccaagctgacattcttgcactctgatttgtttcctagggcagaggacagtaagcaagggacaaaattcttcagggtgtatgggaagtcttcgatccaccccagaagcacagtgtattttacttcacataatcttggcatccttgttcttcaaggacaaggcaattgtgagatcttctgtggatcgaaggcattgtgcccctcaaattatataaagtgggtaaatgtaaattcatgttaccagtgttacaggtcaatcaggggcaaatggtaacatttatggttaacagtgctaggtcctgtttcatttattatctccttcattccttacactgttcccacaaagtagatattattgccttttaaatgagcaaagcagatgtgcagagaaatgaagaaacctgttcccacttcccaagtcacaagtggcagaaatggagtgttgaagcccacattctcgggctccaaagccaggctcctggtgtcttctcagagctcagcgtctttacagcgaggaacattgtgctgtagatggttgttcttatatttaatctttcttcccctgtttcaggtgtctgacaggaagcagcaacggcaatttcctgcttaccctgagaccgtttttaaaacgggccattttggtcgtcagttatgtaagtatataatgtatactttgaatatagctagtaagggtgttttcacttagtctcaactcggagacatgttccagattactgaataagctcactatcaacatcacctcatcaggaaggtttgcaggtggcaaatgttgctcttgcgcaaacgtgtgtgggaaaccacacacaggaatctgagggcgtagtgtgaaccacacagggtttaaagtccctttcaaagtgttttcaaagtgacctggatgtgtcagttctctactgctggacacagcacccagtcctggtacccggaggtgtagacacagctacctgctgtgtgtccaggcggctttagttcggaagctcagccgaatgatttcccgtttcctatgtcatgattggggccagggttatccaggcaggcttatctctcagctgtaagaggaggagacagctcctccacttcttgatggaggatcagaacacatgtacagagatggaagacatacatgtaggtggacatttcatcaggtcttctcattccttcaaggtgactgtcattttgtatttccgcctgtggataatgggaggaacaatgcccctcttctccgagcaggacaatccagcttcgttttcgccttacatccttacaaggtcagtggacgtccatcatgcaaactttatttggtatttggtagttttgttgaacatttttattgctgtaaaatcatttgtacaaaataataggtctcactgcactgagatcatacattctggatcctgtccaataatattaaaccacaggccagctatgcatttcgaggaaatattgatcatggactagccatgtacgaggataggaagggaagcacaatacttatgtttgcaattcttttcaacccatgtgagcatctggacagggttgtggctatgattctcactggtacatatttgttttttcaacaagtattttattagatgcttattgtctgtagtgtctattgagtgacttttaaaacaagcattacaaagcagagcacagagatgtgggcagagattggttagacaacaccacctaaaatccaggagtctcagaacaacgaatagaaaggaacaatatttgcaaagatagtgctaatggttccttacatgtcctcagacgttccagagatgctgagttaggaagtgatgttgatgaatgttcctgtgcactgggaagatgtttgacttcttatcagctgcgttgtactgttagagctttaagataaatcacatttccaattttaaaagcttcagaccaatttctgttttataatgtctaagtttagaacagaacatcacctgaactgtagtggtttgagtggatggaggcagaaacccccatttttggtctcatcacttctgtggttatttaaacaagggttgtgctgtgctactatattcctgttcaataatgatggaggtttatctgttttcttcaattgttaaatgttccttgccactaaaggtcggtgttaagtacaatgttctgaatatatttggttacaaatcatatatttattttcttattgaagagttggctcagtggttgatactggtgctaataatgcagcttctcagttgctgttgcaagttacagctgccgatgggaagactcagtaagccagcaaagaccttaagaatcgggatttattacatttatatttggcagaaggacctaaataaactgtgaaatacattttttaaagaaagcttcagattatactctccatagtgttttaaacatgaagatgtcatgtacaactattttcatagtcatatatgctataaatatcttataatgttatatcattttaatgataaatttatggtagtaatctttactattttggtgtatatatttttgaaatgtattataaaacatggtaaaacagtattcaggaccatgaacacaaacaggtgtcaaagtctgacgttagcttccctcttttcaaaatgttgttcagtcttaagctcaacatctgaaactcagctctcgggcaatagcctgtcctttttagatctcgctcatcgacatgcagtctccaggctcctttcttgctatttttagatgtgacagttcatggatgaacagttctggtctgtggcttcttcaacagctactttccacctttaagaggaaacaggacatcaagtcctgtttctccttggtgaacccactatcttcattagagttattggcataaaaagacaccatgaccacagcaactcttataaaggaaaacatttaattggggcttgcttacaggttcagaggtttagtcattgtaggaaacatggtggcatgcaggcagacatggtgctggagagttttgcatttggatgggcccacagcaggaagtgagagtgagccactgggcctagtttgagcttctgaaacctcaaagcccacctccagtgacaaggccacacctcctaatagtgccactccctggcgattaagtgttgaaatctatgtctcaggggtccatttttattcaaaccactatacccatctttcagtttcaggatcatgtccttcaactttggaatgttttcccttcagctttagtgtggtgttgtttgtctttggggtgatttcctactgagctttctgtctatgaattgaggcagctactctcagcttctcaagtagatgtagcatactccatgaattaagccaggatgaggaaatgaaaccaaataatccttcctgctttttgtcttttcctcgatttctttaagggagcttttcatttcctctttaagggcctctatcatcttcataaagttatttttaaggtcattttcttgtgcttcagctacatggaaatgttcaggtcttgatgtcatgtcgtaggatctctgggttctggtagtgtcatattgccctttctgttactgtgttgttgttgttgttgttgttgttttccaactttttaaatttgaattagaaacaggatttttttttttacatgacaatcccagttcccttctcccaccatcctcccctaccactcccccaccactaaaaccctatctatcacatatcctttctgctccccctggatggtgaggtcttccatagggtgtcatcagagtctatcatatcctttgggacagggcctaggcccatccctgtgtgtcttggctcagggagtattcctctatatggaatgggctcccaaagtccacacacatgctagggataagtactgaacttctacaggaggtcctgtagatttctgaggtttcctcacagaaacccatgttcctggggttggatcagtcccatgctggtattccagctatcagtctggggagcaagagtttctggatgttcaggtcagctgtttatgtgggtttcaccagcctggtgtggacccctgtgctcttcactagtccttctctgcatctgggttccagttcagtttggtgattagttgtgggtgtctgcttctacttctaccagctgctggatgtaggctataggatggcatataagtcagtcatcaatctcattatcaggggagggcatttaaggtagcctctcctctgttgcttagattgttagctggtgtcatctttgtagatctccagacatttccctagtgcctgatttctctgtaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacacactttgttcctgttcacacctccatcatacctcctgggagcacatactttgctcctgttcacacctccatcacacctcctgggagcacacactttgctgatgcttctctagcaaacacccttggtttgtttcctgcttttgctaagctagctcctgatcacctgacttagctgtgatgtggctgcctctgtgaagtctgtctctgctggctccagatttatcattggctttgtctgtctgccttagtgaaaaattcttctgcatttgtctgctaggactgacatgagccctcctagtacttcaggccacaagtcccaaatcaacatgctgtcagagttggtgtgtggtgagatgtctgtttctgtgtggcaaacaaccacttactctcgtgcgtgcgtgcgtgcgtgcgtgcgtgcgtgcgtgcgtgtgtgtttgcgcatgttgtgtgtatggtatgtgtttgtgtgtgtgtgtgtgtgtttgcgcatgatgtgtatatagtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaacaaaaaaaaaaaaaaaatgaagagtttggttcccagagccaccacacagtttcagtagggacagtttggtagctgctcttcctcaggaagcttaccctttctgtgtatttctgtaatgatatcttcctgtcattatgtatttttgacagggcctctcactctagtgctggctagcctggtgctaacagtgggctgggtcctgttacaccaatcagcactcaagacaatccctcacggttatgctcacggaccaacctgatctaggcagtccctcagttgaaacttctccttttcaggtgactctaggctgtatcaagttggcagtagtgcaggctgacctcaaagttgcagtgatcttcctgcctcagcttcccgagttctggggttataagcatgagcagccacttctggctatgaaactctacttcagtcatccctgggttctcaatttaaaaaaatgaatcattaaattttttacatccaatttccagttctctgagttgtatattctatttggttggcaagacattttttcggtttccccccattaataggatttatagtagaaagctggtaaataattttcttttcgttcttgcagagagagagagagagagagagagagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccagcctggtctccagagcgagttccatgacagccatggcatgttacacagagaaactgtgtctcaacaaacaaacaaacaaacaaaaaacaacttaatgatgagtctctgtatccagctctatttattatccactaatatagttttttttccaactatataataaaagcttggtttaatagctggtttctctgacttagcctctttctcagttacttttcctagtgctgtgttaaaattcccccacaaaagcaacttaagggagaaagagtttatttcggctcagtgttccagctgtgcagtccgttatagtgaggaagcagcaatggtgggagcttgaggaccaggaagtggccagagagctgtgactgactgactgggaccagggagcagagagagagctgtgactgctcagcttaagttctccttttcgtttggtccagtctgaggcagagggaacaacgctggtactcgctattagaatgggtcttcccactttggtttacctcatcaggatagtctcatagggcacaccaaggggctagcctagtctaataattcctcacagatatgcctggaggctggtcttttaggtatttttatgtcttgtcaaattgacaatcagcacttaccactaagctatataaatagattctgtcctctggtgtgtctctcaggccattcttaacttatgcatgtcccccattaccatatgcttaagaaactagctccttggtgcagtggtttctcccacaccctgggcactgtgtctccaatttgtcatgaaatgtgttctgatggttcttccgtgtatcccatattagcagttggtcttagaactggtttaaattcaaggttttgtctctgttgttttttttttttaaacaagattatttcatcataggtctgtttaagctttctttctctctttatgacattaaaatgaattagtgagctctatgtacctaaatgttttgtttgttgtttgagacagggtctcactcagtagacctctagcctggcctctgactcatggctatccttctgcctcagcctcttgagtgctggggctgtaggcacctgattcttccatcacattagcgagtgcgttatctgccactaacctaatatgtttagcagtcattatatataattaatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaatttaaatatcttccttgggaactgtgtctttttttttttttttctttctgttgaggtcagcacccaacacagtggctaggaactgagagataagttcccaggtgatcagtttaatagatagtttgatgtctttccctatcttcctctaactgaaacgatgacagaacagacatactgtttcctagaactgtggtaagcaagtgtttgccaaatgtgggaatgtatatttcacaactgttctcttcataggttcctgacctattcctacctccttgccttcaatgtgtggcttctgctggcacctatcaccctgtgctacgactggcaagtgggcagtatccctctggtggagaccatatgggatgtgaggaaccttgctaccatccttctggcggtggtgatggccttactgagtctacactgcatggcagccttcaaggtaatctctaagagcaaatagattctcatatcgaagacatatgtctctcttactactgctccttttcgtaatggggtctgggtcaaaatcacatgttactgacttacaaaagtttgaaaattaatttttcctaatagataatatatatttaaaagtctttagcaggtctcatagaccatgcccttcttaattttatcctgtctttatttaaaagatttatttttaattatgcatatatgcgtgtgtctctatgtgggcatgccacatgtgtatagatgcctgtggtggctagagaaaggtgtctgatcccctggagctggagttacaggtggttgtgagctggctgactgggtgctggaagccagactccactcctctggcagaagagcaattgttcttagccactgagccatctctccagctgtgtgtaatttctttgatcatgtccagatgttttgtaagaataaaaatttcctcctggtatagttggctaatatttgaaggaatttaattgatacaatgtcataaaaaatgaaaatacacttacaaatatttaaggtctgattgagactccatatccacttaatgatattaaatttgatggtttcttttccagtcagaaaaaaatatgaaactgaacaaaattattaagttcaatcatttaaaaatgatcaaaggtagaagaaactagaaaatactgattgatgggaaattgacagacattgatgaaatgcctctcacctgggctaaacatgccctggagcttttctttatgactttgatacaaactttacagcgttagaaaagcaccttgtctgaacatggtgtgtttaggaggcttctttccactgggcctcctcttaatagattccttcctatggcctgtcctctaaaatagcctcactgagcgacaggaaatgctgcccagtgggtttcggaagcaatgtgtttgatatgtgttccttatgtcattctcacaggatttcttgagattttaaagagcattcaatgacttttatagccttgcagcatcctgtaaaaggaaaactggataaacagaggaggagaagaaggaggaggaggaggaggagaaggaggaggaggaagaggaggaggaggaaacatggtcacctagcttggcttggctgactgcctcacagtgacagagatcttttctggcagaggccataggtctgtgcctatctgtgtctttagctcagtctcctaatgatctcctcgagatcaggaccaaacacaggctgagctctgagacctggaaaacaaacctagtcctgggatccttaggaagatgaagttgtagctggagcacttttgtgtgggggtaactgcaatgagggcttgaggaggcctctattgtgggaaggaagcctctgaagccccttacctgaagagcctgatgcattcattcctgggacttccgttagtgtcagttcctagccttgctttccccctttaaagtccacatcacgattctcatctttctcctccctggagagtaggcacctggggtgaagagactcccatctagtgtctctgagtaagatcccatattctcaacaaggaggcaggctagagtaagagcaactgttggaaagtagttgtctgcgtgtggatatcccaaccttgttaagaacagatttagagcagttgagtggacaaccccacactcccctagcccccccccccccccccacacacagacagaccaaagaaggcacaccttgctgttgctaaggaagaaagtattagaagctttgctgcccatgtgatctgtcacaactttatccttgaagcacaaattagccaaccaaccctacagccaaaaattgttctaccatagacccatacaattgaactagacacgattccagattgctagaaattatttttgcattttgctcattcaaataataggttatcatgttattgtgacacatttctagaatgtcccttacaaaacctgatgaaataaacatgtgtgttttaacacagtgaatatcaaaattggagtaagcctggaggatgaagacagcatttaatagcgagtggtcttttttcttccctttccctgccttgtgtctatttagttcccgttctttgcacccagcactttcccattcacgtttcctcaattcatagaaattctcctctcaggaaaatagggactcagtctttctagcccataacagcccttctggatggtgtttattgggccccttgatagttgaggctccaaaatgtgctgccaaggtcccatgtgtgaggtcagctggtggggggtgttcttctgtgtatatgtttctcttattggttgatgaatataacactgtttggccaatagaggtaggaagataggcatgggtaggagactggagaattctgggaaagggagatggagagagaccatgaggagatgccatggagagaccgggaagataggatgcgccaggcattctcccgtaagataaggccatatagaaatacatagattagtagttatgggttaataattaagacagagctagccagtaaaagaagccctagccaccagccaatagtttaataattaatatagcctctgtgtgcttatttggggctgagaaggacagctggatctggcgggacaagaaaccaccagcaactgacagctcgaaagtaggctcagtccaggcagctttccagcgctgtctctgccggatcctcctccttaccttcttacctatagccacgctgatcgcgggccacatttttctacctcagtagctatctatcttccatggttgcccttgaccagtacaatagaatgggaatgtcatctgtaacccttttctgaggtgagtttgaaagtaaactttaccctttaccctcatatggtaaagaggtatgttatgggagagacaagctttgccctggaacttactcagagaccctctgctgctctccctcgggcgtgtcatatcattgtgttgccctatgtgataaagagacggcttcccttctgcggttctaactttgtatggtattcacactttaaatgcatgccacaccacctcaagtgaagcctggcccctctgtacaggaggtgtaagaggagagccaccccaagtcctaggaggagggaggccagagtgggtaatgatagcttcactgctcctcacctgtgtctgttcccctcccacagactcccctcccctcctgcaccatgctgcgaggtcagaccagggcacttggtgccttctgacacagcaccatgatagccctcacagaggaacaatgaagacattccaactgtttgcagagtctggtcattgtcagggtcacgatcatcccaaaagcgtggcagctcaactccaggaggacaaaagggctcctgtgtataaatagcagagtgaatgcaaagaaagccactgactgcttcctttgtctctgtagtcaagacccgtgcttgctcaacagtcacagtgtatatgaagttattgttatttatgaatgtcaaccctctacctcatccttaccctgctcccttcatccccagtggcagggaacatctttaaattctttagaacagctgctttctggacttgaatgctacctgggtttcttttctcatcacactgacaaattgaagggaggaaaagcttctttggccccacagcttggatactcagcccattatggcccagccttggtggcaaggcgagggctgcctgctcacatctggacagatctggggacagagaaggggcaggacgattagccaaggccctccacccagcaacccacttcctttagttggactccaccttctgaagtctcagcctcccagaatagctgggttcaaacattcgaacctgtggctgatgttcccaactcagatcatataacaaacactaccatagaagtgtgcagtctctgtgttcagatgtcacagaaggacaggagtgaaatcactagtttaactgtatgtgaggggcacacacagtaaagaaagtgcctacctgaccattccatggtatgattaagggaaaggttttttattgtgcataagagagaaaaaatccataggcatctggaagagcccagagcagcagagagaaaagaaaacagactggacatggcctgggctatattagagagaaatggaagaatagcagaagaaagtgagtgtgtgtgtgtgtgtgtgtgtgtgtgtgtgtgtgtgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctgttgggagcatttttctcttagaacctcacaagcataccccaggaaaaacacgaccccacctcacaaatatgggtcagttttcttctttgatgtcacacctcacttttttgtaaattcactaaacacttgagtgtttgatggaagcaggccctttgatgggcctctcttcattgccttgaaacaaataaatggatgtgttggtatgtacatgtctggacttggaagattacaggtgtttgaaccataaagcataaagagccttgcttttccatcctctgctgcatgccattaaaccagtaaatttaagtggtggtaaactgaacccatagtgaaaaatgagggaagaatcccagacccagtgatttgtgaagagagccctttaactgcctcttgtgagaacagaattatccattaggctctccccatcacacacctcagaagcagaaaagtgggacatgttccttgattggctacacattgtggtagattctggatgaggacattgactgggaacagagcccaaatctacctgatgacacctggatcttgttgtcctttttctcagtgcttaggaaagagggttcctggtcttgtcacccatgcacagagtgacctgaagtaaggcagacccagacctgccatttgtctgataaagcagggtgagctgttgctaagagatgctcctgtaagccagttagtcttcactaggggaacacaaccacgtgtccctcgtgtctcctcattaatcccagagtatagaacaagtgttcatcctctcagacagttccatgtgggtaggtgaaccacagctctctctgcaaataagacaaggaaaggctcttgtctctttcatggcagatagatgttgatggcatcctgcactgggggaggggggtgcctgcttagtagatgtccccgcacaagtatggtaagtaagaaaacatttctgctggccacacacatccgcaggacaaagtgacttagggaacacttctggttcctgctctgcctgcttcctcgaccccaggagaggaagacccaggggacactctactgtatttaaatcaatccatgatcctcaccaagtcccttcctgagacactcttgtgaagttaagtttattgaccttggattttgtggttgcatgagtttggatctggaatgttctccaaaggcgatgtattaaaagcatgatccctagcctgaagtggtaaaaggtcattgtcattctaccaaacaagcctaggcatatgtgacccatttcctgaagcctaggtgtcccgtgaagtgatactgtacacctccaagcttctcctcattcctgaatcccttctgtctgagtgaaccctgagtgtcactcacattgcattcccagaagagtcaagctcaaatttgtaaagtaagtgtgtgtgtgtgtgtgtgtgtgtgtgtgtgtgtgtgtgtgtgtgctgtcaagtgcttgtgcacgtgtgtgcacgtgcataagtgcgcacatgtgggcatgcatgtgcgtggaagtcagaagccaacttgtaggagttagtgttctcctgctaccacatggatctcagttatcaaactcccatcaccaggcttggtggaggcaccttgactctctgagccatctcattggcggcttcatatgtatatgaagtatgtatatacttcacatacaggcggagtatgtatatgctatgtgttatatgctatgcgtctggtcttggacgttgggtttcaggagagtaacgaccatctcaaaccattccttgattccctgaagcagaacatgtgagaaggagcagtgctgtgtagagtactgggcttgtttctcctgatgccctctgttagacgctgtaaggggcgagatttccttgaccatacagcacctcgtgtggcttcctccacactgcaacatctgactccttgccctggcatttccacctacacttgattttggatatagaagaggacaaactttggagttggtcaggtctcgggtgttttgtttttttgttctgttttgtttttgttctgtagttaggaggagtctttcagactagaaagatgacttggtgggcaaagtacttatgaagacctgaatttagactcccacaatccacataaaagtccagcctggtggtgtgtgctggtaactttattgttgggaggcagagcgaggtgagctcattggatagccagcataacccaagcgttgagcttcaagttccctgaaaaactttctcaaaaatgaactgtagagacagatacccagtgtgacctctgccctccatgtaagacgttacttgtgagcacacacattctcacatacacacatatgcaccacacacctgcaatacatatacaccacatacctgcttgcacacacacacacacacacacacacagagagagagagagagagagagagagagagagagagagggagggagggagagagagagagagagtgtgtcactgtgtagcccaggttggacttgacttctcaatccctctgtttgaacttcccaagtgctgggatggcaagtgtacatgccatgcctggcttttagcccttagtttgaaactttcacttcccactcattggagtgacagctaagtgccagaagccacaccctgaagtttaatggtggccttcccccagcatgttcctatctcctcctgttcctgcctccttctgtcctgcactaacctcaggatactaacccctcagcataactgaccctgaggctcacagagggatttgtacattgaatagacccttagaggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagaacccccacatggtagaaggagagaacctacccccacaagttgttgtatgacctcacatgtacactgtcacaggtacatacacacacagacacacccactcagtcactcactatctatcgtctgtctgtctgtcatctatctatctacctaccagtctatctatctatctatctcctttaagacaaaagaaagggagggaagaaggaagggagaaaatgaatcctagtgatgactagagtctttcaccgatggctctgtaggtttgagaaatacttccgaatttgagctgttggcttatgtctctacaggttcagacttggcccaggggtggtttgtaagggctcctgtgtgctctgtatggaaatctctggttggcagcacaggggtcccttaaccagagtaaccagagcaagcaagactcaggttccatctcctggagaaaaagcatgtagtttctcatttgcttggttttccactttctctgtggcctcatcttgcctccagtgatagaacgtgtttctgttgcccgctactgggagctgcactaaaacaaatgttggaggatgaagtttcaaaatagaggagtgtgtcactcactgtaatgtctgtatctgaaagaatgtaatggttcccaagaaattgcaaacctagcagagattactttctatggcttaatatttctgaagccatgtgtcaattcaaggactttggaggaaaaacaatttatcatgttatttgatacaaaaattgatgtcaaatggtaaggagagattctccttcatcctcacagagcaggggccagcgaactgtgaggcacatgagtcaggtctggccctcttcacagacatgcctattcacttacgtggtggatgcttactctcacacagacagggtgaaggagagctgacagaggcattgtggcctctgtagagatgaaggaacttaccctctgccctccaaatgtctggatatttatgtccaattagaggaattgacaataaagagattgacaggagtaaaggcaaacaaatgtgttcatggacagcacatcaactcagaagctcagagaaggcaaaagcatctgtactctctccccttagggaagaggccagtgggacacataacatgggtggatctataaaggatatgagaggcctgaagaaccagaggtgggttgacacagtgctctgggtgtagacagtgggctgacacagtgctctgggtgtagacagtgggctgacacagtgctctgggtatagacagctgacacagtgctctgggtgtagacagtgagctgacccagtgctctgggtgtagacagtgggctgacacagtgctctgggtatagacagctgacacagtgctctgggtgtagacagtgagctgacccagtgctctgggtgtagacagtgggctgacacagtgctctgggtgtagacagtgggctgacacagtgctctgggtgtagacagtgggctgacacagtgctctgggtgtagacagtgggctgacacagtgctctgggtgtagacagtgggctgacacagtgctctgggtgtagacagtgggctgacacagtgctctgggtgtagacagtgggctgacacagtgctctgggtgtagacagtgggctgacacagtgctctgggtgtagacagtgggctgacacagtgctctgggtgtagacagtgagctgacccagtgctctgggtgtagacagtgggctgacacagtgctctgggtgtagacagtgggctgacacagtgctctgggtgtggacagctgacccagtgctctgggtatagacagtgggctgacacagtgctctgggtatagacagtgggctgacacagtgttagagtgtggtgattggttttcagtctcttcttctgtggtgggagtttaatcttcctcggttaatgtcgtttccctaagcagcttacaggcagttgtatccccctttgattgatccagtctctaggtgggtatgggaacttcacgaaagccctcacatgtgtttctgtgaaaataggattgagagacaggaagaagggagactgggatagggaaggtcagagaggccttaaagacgctgtttcagtagcaggtaaattcagggctcttgggggataatgttttgtgagccccaatatagaaaacatctgccctgtttactgcccatctttttagaggaggagtttgtaatcctcagctttagcattttgtcagattctgcatatctggcttgttgagtgttagcattggggctgtaggcgagttcttcaatttgtctcggtttttcgtttcttcactgaggacatggataacaatgagaatttgtggttcaagtcagaaaacatatgcaaaatacaaccccttgccctgcaaatgctgttgagatctcaaatgacactcttagcactgtgcctggcacagaggacgtgtctgtgaacacccagacacacacaaactgatggtttcagtcactgtcttcatcatccttgtctgccaacactttagtgcaccactgtgcatctgccagggttccacacccccccccttccagctgttctgtcacagggcagctgtggttcctgcaaccagtgtggtctcacgaatacagagctaacacttagtaggtgacatagtgggtgggataggatccagcctgtcatatcaaaaaccatatagcagggcagcatgtggggtcaaggtgctgggtctgaattcctgggctagtctcgctgtccctctgttctctagatatctgacttaattcaacatccttcaccctcttcaccagcgtcttcttggattaagagcccctggcatccatagctttgtgggaagccatggtgctgcccacacaagatgatagcccctaaccttagcaatcttcatgtggaggtgagtagggagagaggaagcctgggaatgcaaatgtctgcatggcgtgttctccatgcatttcaggccttcatgcgtgtgtctgcaggttcttacatgaccatccatgttgaaatacccgtctttctactgcttgacttcctcatgcagcaaagtataacacacatgctctgtacttaatctaccgtttcctcccccatgttccagaattgtgattacagtcttgtttattcactaataagttcttggtgcccgtaatactcttatctacatagtagtcagtaaattataacgaatgagggttggccgtcaaggtgagcttgatccccagcatccatggaaatgtgggaggagagaatcaactccacagagttgtcctcagaccgccacacaagcggtactctcacacaatagtaatgaaaaattaaaattatttttaaaaacaaattataacataggaaggaatggactccagaggaccttcttgtggtcccacaagcatcctgactagcttggaggatgggggaacctggctggggctagaagagcaggcagcaaggaacctcatgcacttgagtagccattatggtcaggcattgcagtaacattagcacaatcagttctacagaaacagtagatttgtagaggagcctcacatctttaaggtcaaatatggacattgtaatgtgagaagactttttttttttttgtattggagaatgttttgctgtgtataaggtaccgaaggacctgtgtcaactgaattcagtacttggggtcatatctgggaacccacctacgtaggtagatggggactccctttagcaaactttatgttctcttgagtctgttctgccagtagcaagctcctctgcatgtgcatgagtggtgggaagaaccatgtgctttcagagatgtgatgctaggccaaagcctgggaaagccgggcagagccagtgaagaaacctcattagtccagctcaggaggcagcctgcaggtggatttggaaaatgggaggaccttagccgatgcactgggaggccttgtaggtggcgtatctctggtcctccctgactactgtctagcccagatgatcctccaggctgctgggtcagacctacaggctctgaattcaggcataccttgtgatggaggcatgaggaaacctgggccagagaatcccctcaggtcccatgtaagactttccatgcctgaggctttgagcctatggctttgcagcaatgctggagagctagtgagccatcctgtgagagctagtgcctcagacagcccacccctgtctgtgacaggagaattcatatgtgtccctctagaacagagcaggtctgtttgtcctaatagcacccataatgagccccaacccacagtgaccgtcttagtcactggtctgttgctgtggtgatttattattgatcatttactaaagcttgcctgaggattcagaaagcaaagacaggcacaagctatagaggtcaggcagcggtgatacacacctttaatcccaccagccacactagatagccatagaagctaggaggtgatggtgtacacctttaatcccagtactagcgaggaatataaaataggagctcagattctagtcttagtttgtattcagactacactcacacactgaggataggatctccccagccttagtagaggtaaaaactctttagtggctggctgctttgatattcatcttgaaccccaatatctgtctctgagattttattattcatgctacaacttggctctagtgaaaatgtgtaaaaacattagattagtacatttttctataccttttaattattgtatgttgtgtttatagaaagataattgcagatatagagttcaactagatatctcaatatatctagatatctaaaccacagcagcatgtttctaagcagaatcctcaaataaagacattgttgctacctgtcataccacttgctcatgattcagagtcttgacactgagcagcatgtagccacttctagatcagctgcctctactggcatgttcagacaaggaggagagtcttccattagtaagtgaacgtacttgagttttgtacccacgaagaccatatgtaatacttgatgtggctatttttcagaaagaaaacaggttattatttaaagggggacatagatgttgtatagtttaaaactggagatagtcaatatgcaggtcattttcccatggcctataaactctgtcattagctgtcaaagacatttaagataaatgattacaggtatcagtacacaaatatatagaaggaataagttgtggtgctccacatcaccttggggtgactgcagagttcaaaataatcccttgttattatatgaagatgtaggaaacaggagctcaaaggttcctacataaagacataatgagcaggaaatgctaattacccatttgatcagtgcatactgtaggcatatgttgaaatattgcaacccgtatctcaatctctctctctctctctctctctctctcttttcctggtggttttgtttgtttgtttgtttttctctgtgatgaaatttttttctgaatacaagcgtgttgctgggttggtattaacagctctggggtagagcacttaccaggcaccctggattagatccctagtatcacccatattggtgtgcatatgtatatttattatgtgtatatgtacatatatgtgaattgtgtacatatttacaaatatgtgaacacatcttatatatatatacataaacacatggatatgcattatgtgcatatattcatatatgtgtttatatgtatgcccaggtacatgtgtgcatatatgtgtgtacatatttacacagacatacatatctttgtgtgttcatctatagctttcagcctttcccaaagtatgaatattggaattagttggaattagtagtgaagaagtgaatgaatgcaagaatgaatgaaaaaataaggtagatgttcactgggctctgctatgttttgaaaataatatatctgagactgggtgtggtggtgtatatctttaatcccagcacttgggaggcggaggcagaggcagaggcagaggcaggcagatctctgtgagtttgaggtcagcctggtctatagagagttctggggcagccatggctgcacagtgagaccctgactcaaaaaaaaaaaaaaaaaaaaaaaaggaaaaaaaaaaaaaaaaaatgtgttgatcttaagcattaatgtaattaacttagtgtacaagtctgggtgtcatttaacagcatagtgtcatcacagccctgcttagcacagagtaactgctgtaagaagataagcctttctgtttatcagaaattataatgggtttcatgttgacactctctgcatgaatacaagggattttgaccacattcattctccattcagtcttttgtcccctgtccactgatcgccttcttttgaactaatatcctgactgctttcatttctttgtttaacaagttttaagatttttattttatttcattttatttttttttatgtgtatgagtatcctgtctgcaggtatgcctgtacaccatttatgtgtctggtgcccacagaagccagaagaaggcatcagatctctgggaactagagttatagacagttgtgagccatcatgtgggtgctgggagtcaaacacaggccctctgtaagggcagccatgctctgaacccctgagtctctccaggcccccttccctttgtgagttccattagggctgttaacaggtttgtttataggatcataaatacttcacccaaggctacaccactgaagacagagtctcttcctaccaccaaatgttttgcttctgcttttttagtgccttcacagacctgataaagaactctggggctttgccctagccttcctcactcaccgaggttctcacagaacacaggggcctctccctcctcatgccttagtctaggggcgttgaagttcagacttcctcctggtctcttggtttaatctttctctcactttgagcagctgactttttatggaagacttcccaaccattctgctattgtattgagcattttccctggctaaagccacacactgggaatggcatcttctatgatgtttactgcttaatcaaaacaacttagtggtggaggtgggaggcagtgtttgctccaaggataataagctagagttcaaaccctctgtagctaatacccatagttaaaaaataagtaaaaacagcaacaacaataaaactggaacacacactgacttgcatcccaaaccttctgtcccttctgatagaagtatgttggaatccaatagctggttactacaatacaaccattgcacagctgtgctggcagggactgtggcctgggaggctgaagatggaggtttctgttccaccaggtcctgccgccctttggccccaaataaacacactgaggctatgttagttataaaacttttggccaatggctggggcttcttactggctagctctctcttaattactaacccatttctgctaatctttgtattgccacaaggctgtggtttacctgtaatctggcatgttactctttcagcagcatggcgtctctccccacatctcctgcccaatcagtgttttattcatcaaccaataagagaaacatatatacagaaggacattccccatcatcaggcctttgaagatggggtgattttgtgtgtgtgtgtgtgtgtgtgtgtgtgtgtgtgtgtgtgtgtgtgttgcaatcaaaataactgatactttaaatacaactttgactctaagtcgtggggaaagctggaggcttgtagaatcttttttctctttaaggctagatgtgcacatcttcatctgtgagaaaacatgctaatctcacttggacacttcacctccagcctctgaggtagggcagggtgaacgagtgactgaaggcaacatctggagttggacttcctaactgcatgctaattgcttgctctcgggccaatctcttaaagttcattgaaaacatggagaataacagtgtttattatctaaggtataatgtaagaatagaacaacacatgagaaatacccccgacaatgtttgagatggggtaagcgctgtgtaaagttctcagattataactgtgttctggcatcatagatgagaaagatacaggggtgacagggagaaaggaaggaaaccaggagaggaggactccctggaggacctggaagctagcttagagcagatgttactggtatcatctctctcagcgtcatatactaactagttttaggaatgaacttgatgttggctttggttgaaattctgcccaaatacttaccaggactctggcctcttcatctatgttacaggatacagtagctagcatctgccgtacagtgtggtgatgacatgtggtaggtgggcacttggcccggtgtttggttgaagatgggtggtagacaagcatcgccatctgttatggcagtatgaaaccttgggccaaagtcggactcaaaaccagggcgatatagctttcctcctttcctttctctgatgctctggctgccatcaatgatgtttttgttcattttattgttcatattaatgttttttttattagattggtatttaaaaataacggtcatcaatgatgttttaatgtttaatctccagctagcaactggagacgggtccaccaaccttctgttcagtaatgtgaacaaaataagttgctgttctaaaccctgggagagacatgtgatgaagatggctgtttctgttttgttttttactatttcttctatgtctcaagtcatctacaaataagaggtgtgaaggagatgtgtgaaatgcaagtgttgaaatgctgagtggtaaaagctggggagatggctcagcagttaagaacactggctgcttttccatagggcctttgattcctgacacccgtatgacagctcacaaccatctgtaactccagtccaaagggattagatgccctcttctagcctctgaggacacttcacagacaacatgaaggcaaaacacacacacacacacacacacaacacacacacacacacgcacacgcacacgcacacgcacacgcacacgtcttaaaaaaacaaaacaaaacaaaaattctgagtgttggcatactgcagtgatctcagcacttaggaggtgtgcacacccacactactttatttttagtgaactttatggttcctcaagtctttcgttgacaggataaaaataaacaagattacagtgttttaatgaagggtatccagagtaaactctaggatcaccccacctaacttggtttgcatctttttattgaacactgagtttatttctccctctctactttctgttaccaccttcctgctctctgctcccgtgggtttgaattcttagaaacacagcacttttcctatgtgtggcttttgtaatgtcttccaggcctactcatgtgtcaaacattgcacgatctcctcttgtaaagctgactatattccattggacagataagtcacagtttctcttttgttgttgttgttcatctgttcatgggccttatgttagtgtattatgattatggtgaataagggggaaagatgttgggcgtggtcaggcaggcctgtagccagcccctatgcaggtgtggctacaggttcccctaaagcccctggcaatgatttcttagatgtcacaatgaagggtaagcacaggccaataaaagcagaaatgaagaaatagggaactgttaccaaactgtaaccttggtgtaacattcttgggatcattagcaggattataaatcaacagcttagaaaatggagtccttgcagactctaggtgggactggaatccagcttactcatccttagaaacagaagttttgcaaagggttaaaaatagagtcaccgtgttgttgggtgatgtgtccctgtataagtccacaagaattgagactaatactcagagtgtctgtactccagcaacagggtgtaaatatgtcttcaactgtgtctagatgacccatccctttgggacagtttttagcttcctgtggccctaccaagccttgctacagttgcttgagtttcagtcagggggctttgagtgaaaaatataaagaggctgttatttcagcaaaattgttcctaatgtatttccccagtgggttttatatgatgtgggatttccctactaatattatcctcatgttaaaaaattaaatgaaaatttcatctatgagaggtagtccagtacagttcagttgccaataaagcaggttctcatcaactgttcccctttctctttcagtcaaaataaatcccaggagttttctctccaaatagtcctctgtcctgtgcactttgctgttaagagtgtcctgccaccacttccctttaggcaaaggaacaggctccagacccaaacaccatgtgctcgagtcccctccctgctgtctgatcttcttcagatgcacaggacaagctgaccctctcctggccccacccttctcttattgtccccctgtaggggaccccctaggtctatgatctcaggcctgtgatggggaatgcagccttggtgtttagccacggggcactgggacgtaccacccacagtcactgttgattgataatcattatgtactgtggttgagagcaaagacagtgggattttaatgggctgagtcccccaacttaaattcatcgtacagttgtactctgtttggagttggagtttgggagggaaatgctaatgaatgaagtcattaagatggggccctggcccaaggtctgttgccaatacaggaagaggacatgagaacttattcactgggcacactgacaaagagaggccatgggaggacacagctaaagagtagatgtccacaggccaggagcagggcctgcccaacagtgaactgaccagattagatgctaatcaacagaattgagagaaagaaatttcttgtttaagccacttaagctgtgatgtttcattatgtctggctgaacagaatatcacttgctttgttgttgttttggggtgtgtgtgtgtgtgtgtgtgtaagacagagtttcttcctatagctctggttgtcctgtaacttgctttgtaggccattctggccttgaactcacagagatccacctgcctctgcctctgcctcctgagcgctgtgattaaaggcgtgcaccaccactgcctggcttatcatttgcttaagcaaggtttttgatgcttccaaaatcttcatttcgttaattatagaataattattcctacgataatttaagttagtgtagacttgatatggcaatattaatttcaataaatcttgtcaatagggatgtcagcctacattcatctctctggtaatgattcatttttgtactcaatctcaaattactggaagaaagaaaacaaaaagaagggttagctgaatgaaggaaggaaaaacacaaacaaacaaaaacggagtggcctgtaggtgcaagttttctctgatggaatccgtcacagattgtgccacctccccctcctggccacacccaccctctactccctctctccttcccaccctccttcctctctgcagttcctcagaaggcctccctacctgcagtccatttgcacaaagtacgctttaggatccttgtagaacactcaatggtgggcatcatttctcttcttaaagccctgccctgattcccccactgctttgcaaatgaagcccagagttttctgtctgatcaccaggctattggtctcctcattctcagtctggtctctctgtgctcaggcacctcttactctcttttggctccctcccccaccgttttctgctctcatctccctgcatcttctaggttgcttgttgcccgatgagaggcaacttacgggtgggaggatttatttggggagataaaaaccatcatgcccaggaaaccatggcagcaggagctagggttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagaaaaccccaggaccattcatcattgtgacaattgtttctccctggtgattggatagactgcctgtacttcagtagtactgtttcttggtgggaattgctgagagggatacatctcctacccaatgggttttctccttgaaccctggtgtatctcacgtcctccatatttaccacagcaaggaagagagtgactggggaaatgaccaggtagaccctccctcacaggaagtggtatttatctgttgcgttggtggggagcagagggcagaggggaagcagagcctggctgtgaaccaaaaagcacccagtgacctacttcctccagtgaggactcctgaagagtctacaagttgcaacagcacctccagctgaggacgagtgttcaaatgcacgggtctgtggggccttttcatgcacacaccacctcagaaacctgcccttaaatcttcagcaaatgctgagcatgtgttagctttgtgttgccgtgaggggcagctttcctgttcacacttaatctcggcactaaagcctgggattttcatatgagagagtcaggattttcatatgagagagtgggtgtatctgctgtctgtctccagagctttctaagtatcttgaatttgcaattctcctgcttcagcctcccgaatagctgggattgtaggcctgcatctcagccagccttatgaacacttctcagtattttattttaccttgaaatttcaaatgtacattcattcaccaaccttctagtaacaaaataaataaataaataaataaataaataaataaataaaagtccttaagagcctgcggattagactttgcaatgtcagtgcccactacaggtttgttattttagagtagaataaaagttaaaggtgcttgcagtcatttgcatagacaggttgaatttcgtcttattttcctccaatcctttacggttgcttcacatctaaatcagtggcaatttttttggacaaccctctcgttttactatttctaatttacctactttccttagaaatacaacttcttattcccacacttatattttacctgtttgtaaagtatttcaaagcaatgaatactgcaagtgaaaaaaaaaaaaaaacttcattagacacagctgagttttagtagtcctggtttagctcatgggagcaggaaggctgagtctttgagttgcaaacatcccaatatatttacctggtttagaggctgtctggaaatctgttggcacaattaacaggctctttgaagagcagtcttactacaggtgatagttataagatctgcttctcgataactgtttaaacccccacatagttaaattcagattgttaaactgtgttggttaagtaccagcacctggaacagagactaaagcttgcctttgtccaggtggatcagaaagatttctgtctgagcaaggtgatgcaggcttgaaatcccagcatgtgagaggcaatggcgtgaatgccactgggaactcaaagccagccgggtctgcatagtgagttctaggcctgccagagctatatgatgaagaattgcctgaattctcattcccatccccaaagaaagaaagaaaatggggtgagggaaggaggggggaggggggagtaaggaatccaggaagaaaggaagggggaggaaggagtggagggagggagataaacctctctcctctcagggtaagttccatggaaccttcattcacttgcatgtgtcaccccctgacacatattctatgtgcaggatgctatgctgataaaggggcggtgaccccctctgtcattcagccaactctctttacaaggatggctccatcttaaactcacagttaaagtttggccaccacaaccccaacagtacagtcaggtgattcgatgcccactctgaagtcactcaggtggacatttcagccaggtttatagcctcaagcatgaattccctcctgtgcaagaaaccttaaggtcaatccaaaatgactgattgcatccaaaacctacatgccactattgcaccagagagcacatcccgcctggcaggtcagtcagtattgttgtatgcagagttcatcacagggtaagtccactgatggggtttttcttccctaacagcctatacagcatttctgccactttgaaagctagcctgcagggaagaagttttcagatgggttccaacttgatctctctgtgtcctacaaccaaagtatgtcgtatcttcagcaataggtgaagggaccagctccccatttcggcagccatgacagtaacatgtgcttttctgaccttgtcttagtcactagaggttaggtgcctgccttcgtggcaaggaaccaatcagaagttagctggtggtagtatgctttacagctctgggtgtgctttacggacaagcactcagcagtgacacgcagagcatagcaacaaccctgggagggcctatgggccataacaaccagttggccaatcaacacagggcaagccctcaaagcctgaaggcacaccaatcctgagcctgtgtgtacccctagacactccccttacgctgccctacaagatctctatgcagccccttcgagctgtctttgctagccatccaccatggcgggtaggtgaaagacccgagctaacttggggttagcttgttaaataacaataaagcctcgtgcagtttgcatcaagctttcgaatctgcctggtgattggggtgacggcggtcctgggctgggaccccggaggcctgagttttccgggggtctaacataggctcttaccatctagttatggggggcaaccaatagcagtggcaatagcctattttcggggggagggttatttggggtttcctgaccaacaactcatagggagatgtcttagttacttttctatggctgtgctaggatacaatagccaaggcaacttatacaagaaacagttttggggtacttacagtttcagagagggagtccatgaccatcattcacagagcatggcagcaggcaggtgggccggaccctgaggccatagctgagagctgacaccttgatctgcaaacacgaggcagagaaaaaactaactgggaatgaatgggctcttgaaacctggaagcccaccccagtgacttacatccttcaataatgtcacaccttccaacccttcccttaccaactaggtaccaagcaatggaatacatgagcctatggggccattctcactgagacaccacaggatgtggatcccacagtggaccagtctcttttctatcggataactaaaatttctcttgtgcaaaagacgtatccagtgtaatggttgatttccatcgttgacgactggttaagaaacacccaggccattgatgagccgtgccactgagtgtacctgtgagggtgtttccaaggagggaagatctactctgcaagtagctagcaccactctgcaagcttgggtcttcaactgagtgaaaagggaaaaggggtggctggacaccagcattattaccgtttggggtagctacgagtaagcagcctcctttccccatgctttccccatgttttatcacaggtacaagaaagagaactaatacatccatccactatttgattggctgacgcatggggaagaattgaactaaaatctattgcagtttgctcagcctatagacttgtcagaagaacaaagcccattgatgtagttctttgtgtttcctcctacgcgggatgactgaaattctacagggaaatcccattagattgagataagagtctgtgggaaaatgaactaatagaggaaggagtgtcgaagaagcacagttgtcattagacactgaggaaacctgggatgtctaattaaccactgctcttgatgcctccagtctgtcagcattatctccttgtaattcctttaaaatgctgtttataagctgctttagtttggtctttaaaactcaggcgtcagtgagtgtttctagaacttcctttacagtctgtgctgagggaacatttcagatgtcttcctcatggccacgacaccatctaccttgtgcctctgggaaaaaaaattaaaatcccagtattattagccaggtttagccaggaggatatggtttctttggctgctgtggtatttttatcagtgaaattctaaagacatttccaatatcgtaagtaggaatttgaaattattttgttttttttttcctgttgatgaaccaagaggaaattatatctttaacctacatatacatacacaaacatgcacatgcatacacacacatatatcaaatacacacatgcatattatgcacatatgtacacatctgtatgtgttttttattatgtctcatattcacaaagtttaaggaactaatattactttatttgggaaaatactgaattttagtgaaattgtggccaacttatcaactcagtttcaaaatgaaagtgttactatttatcttcaggaaagttatgtattctccggctgtcttttttcctctccatgtctcactttcctttaattcgcttagctgaggcttcccaggatgtagactccagggcagaggttttcaggcaggaaacccatccagttcactctcataaacacaggaaggaaggaagcagaaagcaggatggacaggggtgtggggatgcggtgaactgcaccaggctcactgacgctgagtacttctgcagcagggctgaccgttcagagctgccatgaggggacatcagtatagatgtaccctcatcagctgggcactacaccccaggcatctggtggagaggcggcgggcctcgctagcaccatgtcctgacacctggaaatgagtgcctgcaaactgaaggcacatacacaacaacagacactgattcttcacaggagcggtaacccttgcccaaaatgtatgggatctgagtgtttagagttcacagcattcatcagagtagagttttgactttatgttaatgaggatggtgctgccaccctcttcaaatagatgccagattccattgttattcctgtagccagctaaaagtcatgtccaaatcactcatcagatagcattcagaaacaaagtctaaccatagtcaccatccctactgtcccacctgtcacctagaccttgcagcacaggctggccttgaacatggaacaattcttctgcttagccgtgaaattatagctgccttagttatggttcgtttgctataaagggacacattgaccaagggaatttttataaaagaaagcattttattgggaatttgcttaaaatttcaaagcattagtccattatcatcacagtggggagcatggtggcatgctggtcctggagctgagggctttatgtcctgatctacaggcagcagggagggagggagggagggagggaggaagagaaagactgggcctggcatgggtgtttgaaacctcaaagtccaccccatggaggatacacctcctccagcaaggccacacctcctaatcctactaagcattcaaatacttgagcttgtagaggattcttattcaaaccaccacatttcattctcataggctgttacctatatcaatcataacccaaaatgcatttggtccaacttcaaaagtccccgtagtctatgacagtcttaacattgttcagaagtccaaagtctcttctgagacctgaggcactctcttaactgtaaccctgtaagatcaaaatgaaaacacagatcacatactgccagcatacaatgacacagaatatacattaccattccaaaagggagggaagggaacatagtgagggaatactgaaccaaaacaagacaaaaaatccagcagggcaaactccatactgttttccatgtctgatgtcaaagctttcttcagatcttcaactcctttcagctttgttgactacaacacacttctctctcttaggctggttctaaacctagtctgaagctctccttggcaggtgtcccaggattctggcacccccagcatcttagggtctccaaggcaatccaggcttcatcttcacagcttcacacaatggcctgtccaggcctccattcagggacactcctgacacatgtctgcccgaagtagctgtccttagccatggcagcaaactccgcaacctctttcttgtatccatgactaaagccagaactgtgtggctaaagctgccaagttctgctgctttctgggctggaacgtgaccccctcattcaattacatctgcatcagattctgtttccctcactacttttctttaattcctttttacaagttggaagcttagctgggtagggtcctgtgccaaggtcaccactccctctattccatctagcgtcaggcctttctttaaactctgtgtgtccttgaacactaaacttgtttccaacatcacatttccatgtgctccttttctcttcaaactgtacactttgtgtttttccttgtcccttttcttattgtggatctgcataagacttaacactaataacaggacagtcaatactagactatctttaaatctcctctgtcaaagcccttaatccaaaactcttcaatttagcttggaagatttttagggctagaaaaaaaagcaccgtattctttgccaaaatatcaccagagtggtctttaggccactttaatatttttgccctctgaagcctccagagctgggcccctacattccacatggccctcctcaccactgtcttccatgcttcttctaaaatagcccagtaagccccactcaaagtgcataactggttttctcttccacactctgccagtgagcaggattataaggcatgtgacagcaatgccctagtccctggtaccaactgctgttgtggtcattgttctcttactgtgaagagacactatcaccaaggcaattcttataaaggaaagtgttaagtcgggcctcgcttacagtttcatagtattagtccattatcaccctagtggggagcatgatgggcttttgaaactgcaaagcacgtccctgtcaaggccatgcccttcatccagtagggccaagcatacatcctgacgtacttcccacatacatatcccaccttccacctatgtgtgatcaagtacatcctgtgcagttggggcaaccaaccttatttacagaagtgaaaatatgtggcttgttatcctacacgtgcaacagcccccagcattaccacaagttgtctgtccttgggcaagtggggcttacaggttagatgaattttggtttttagatctctcaagcatagtgattaaaacttaaaatataaaatccacaacatctttctttctctccctgctcttgccccttcatcaggaccagttcccaccatcactgtccctccttgtaagtcttcagtgtagaacaccttgaggaacaaggagcccccggtcgtatgtgttttacatgctccctgcagctcactgtttccacttccgctgtccatttcctactgcctggaagcaagggcaggttataggcctctgacagaggacctggcccactgtagagaagaagcctgtgtgatgacagcgacagcgtgtaacatctcaggcacagaacacttagtgagtggtaactggtgagtggtgattctcagagagctatgggcaatgagggcagaatagctcatccagtactgggatctaggtattgccagatactccacagcctacctacttccaagtgcatgccagcgacgatccccagtggtcaagactgacgtttggaatgtgcgcccttcccgcctccatgctctcctccgctaagagttgttgattaggaatgcgggcgtatcttcctgcccactgttatctctaggttaactcaacagccagtatgtgttcatgccaagaaatgccatgacaacagagacccaggagcacacaaatctgtcactcaaaaggcacacaggacttggaatgacctcctaaccttgggcatggctttaaaattggtctagcattgtgtttggtgcagaggaaatgggagaaaccttggtttctaggctgctatgctcccataggcctcccatgctgctaggcccgtgaggatcaattcctcctactgtgaagaattgacagttccccaagatggaaatggctccttagccttggtaccaagaaggcacagcacaggaagaatgggcagataggagctggtttaagtgtttgttcactgggctggtgatggggaaagaataggtgttgttttgactgatggaagcaatggaagcaattcaaaggcccctagaggccaggaagaaggtgagcggtgtgtgtgtgtgtgtgtgtgtgtgtgtgtgtgtgtgtgtgtgtgtgtatgtgtgttcacgggtgcaggtgcattctcttccccttgttttttcaagacagtctctccctgaatatagaggcaacccactgtatcaattaggcagccagtaagctttaggaacccacctgtttctgctccccaaagaccgagtttacagacatacacaaccatgtccagcctttgcatgagtattggggagtccccaactcatactagcatggcatgcttgtatgacagggactttgccaactatctccccagtccaagagtgatgtttctggagagccctagcctgacatgtgatcaccagagttctgcatctgaactcaaagtacagttgtgatgatgtcttcatgcccttatctcattcacatggaaagtttataaaagcagctaacacacacacacacacacacacacacacacacacacacacacacacacacacacacacacaccgcatcacacctagcatcatgcaactggcatctgtccccagtattttccccatggaccagtttcctgtccaccactctgccactcaatccaaagttcatcaccctgcaaacctttcctattgaaaagagcagggaattgttagtttagtagattttcccaaacccaagaagtgaaatctctggagtcaggacaatacagccattacaagtgactcacttccggagggcttcaagaaaatgtttttactctgtggagccttggccaaattcctgggtggagtccctctaccacagcactgaggtcactgaggtgaaagggtgagaggtcatgtttaatccctaatgctttcttccagagatcaggaacccagggaaaaaaaaaaaaaaaaacggagaaggaacagagcaggtcaagtgctagcaatcacttcagatgatcaaagacgctaaccagtaagatcgccagtgttacccagggccagttagtgacaggatgattgaactcatggcacagaaggaaccaagcatttgaagtatgccgaatcagcagtctatcaacgtctgaagagaagttagttctgagtatacttcagtccagggaaactgagcttcaattacagagagatatttttcctagtcatatttgcctttgtgatttttttctcaacaggaaatagaaaataaacaactttagagtagttaacctcaaataaattaatgtgtggcatgaaaatcagacacttgattataggtgtgtgtgctctgggagggagctgcaaactataaccataaatcaatgttatttgaacaataaaattactggtaaggtactgaaaggttaaaaacataaggcatccttaacttttcaattttaaaagacatgaatgaaacaaaatataagcccaaacttcagttccaaacagctaaatctgtgggccttcacagacacaggtggaaagatggcacagtgggcaagagctcttgatgacctagcatgatgacctgagttcagatcctggcacccacattagaagccaagtgtggctgcttgtgcctgtaacccagccctgtgccagtggagactggatcagtggggcttgctggctgccagcctagctgcggttttgatgaaagaccctgcctcaaagaaataagacagagactgatagagcaggacactaagcatccagacacatgcacacacatacgtgtacacacacacacacacacacacacacacacacacacacacaccttacaaacagtgactacaagcaggagctcacttcttacaggctactgagtgtaattgactccagctagttcccatacaatgtgtgcttctcaaagaggtaattgtataaactaaggacatgaccactccaaggtatggttgaagggaaggtttttattataaatatgaaggagataactatagccatctggaagtatctagagcaggaagaagtagccaatggaacatggccagcagaatgaacttggtcatgcagagagagagaaaggaagagcaagagaggaagacaaagagaacgagggcaaaggagaccaaggaagagcggggctaagccaaaatagccaggttataagggagtcagaagctagggaagggaagcccatgagttagagaggtgtagggtagggagtaagaagagccagggtgtgccagtcccaccagtcaagaagaatacactaccataatttaaagccaagtttgaagcaagcttttattaaatactggtcagatccatggactttctgaccaggtctctatctctgggtttccagaaaatggccccaagccatggttcgcaggggcttaaaaaggtaaaacccataattggccatatttcccatggggtccactcaggggtaagagtccaccctgatgaatttcctgcctgtgaactcgcccccacatgtgatccagcacattgggtgcagatgggtcaaacaaacttgtttaggggagtgaagcgtggtttgtttgttacctccataaacaacagctcccagcatttcaggaagtacatgtccatgagaagaggcttgcaggtcagaggttttcttgtttcatggatctcttaggcacagtaattaaaacttaaaatgtaactttggttctcacagatgccagtgtggactcatgttgttttaatctaagttattatatttaccataaagactcaggagtcagatattggggtgaaaagctactagatcagagaagtcaaggagcaaccaactctatggctaattcttgtcaactagtccctggctccacccccaatccaacattaattttattagctaagtctcagagtgtcacagtggggacaaatatcccacaacagactcagtaacagatataacagttgtgatactgggagagcttggtggctagtagtagcacagatagccatttgtgtgaagtttcttttgtacctgacagtaaatgatgattttaagacagcgggtgatacttggaagtaaataagtatctgtgaagccaacatttttacatgttgcatagatttcactctgccctctgagaactggttcatattaggtcacaatttaagtgaactgctcataagaagtaataaaaatattctaaatagaagtttcaattcctagcaattcatttatttgctgaggtgaagcttgagtgactcatgtattatttgggaaaaccaatgattgacaggaataatttgccttcttaacacctaagaggacaagtatttctgggatggtgcttgtgtgagcatgtgtgggggggtgagggagggagggagggagggagggagagagagagagagagagagagagagagagagagaaggagagagagacagagagagagagagagagagagagaaggagagagagacagagacagctgctttagttcatttttcccagcctccttttccttgatggtaaaacactacactgggaatttttaaatagggtgatgtatgagaaaaagcttcaaaatgccatttgcattagcacatactggagtgagctctgtcttggcttttgtgcattaaaggccagctctatggataagtagcaggtagagcaagacttctagcctgctaaggatgtccactccagattggtgagaaagagctgactgtgtggtggttctaccatattgaatgaaagactgaattgactcctccctcccttcatgtggataatatagtttgctgatacatatcccacctgctttttatttcttttgaattttaggaaggctgacttatacttcatcacatgctaatttttgtgtctgaactgttttaagttcttaacattttaagaactgtatcaaacgtagtggaaggaaagtgagggagatggggaaagagggtgaagagcaagtgtttcctttcatgaggagacaggagacttccaccctttcctggctggggcagtcttatcaggttctgatccagagatatttgaaaagatcccatataaacagaggctttttctgtgtcctgcccagccctgtagctgcttacaaaataatcactcagaggcttaatattaattataattgtttggctgatggctcaggcttattactaaccagctcttacacagaaattaacctattttattaatctatgtattgccatgcagctgtgaccttatgtcattttctacatgtcttgcttcctcagtggctggctagcatctcctcaaccccgtcttctttcacgcatagcttggctttcccacctaactatattctgccctgccataggccaaagtagctttattcatcaaccaataaaagcaacacatattcacagcatacagaaagacatcccacatcaatcccttcctgaggggaccccacacgggtagtaagcactgaacagggaactggtagctgtgtgacctcgacagaaagttcccatccagggcagggaagattccttggcagagggactaaaatgtgtttactcttacagatttacattttcttactcttgcagtgttggggtttatttccttacacctctgagtctaaaggttttgctttctgctatatttatttgcatgccttcagctgcaaaagcacttatgacacagacatcccattacaaggaaaagttcagggtccgttggggctgcgacatgcttggagtgccagtttagaagtccacgtttaacactttgattttccaggctgtacccacgccacgcaagtgcactgaacaacctcgggacactgacaaaggacacggcagaggcaaagctgtactaccagagggcgctgcaactccatcctcagcacaaccgtgcgcttttcaacctggggaatctcctgaagtaagtggggtggctcctgcgggctgggtggcctggagagttcccgagacccaggtttcagggtgctactgatgcctcctagcgatgaatagttttcacacctccgtcatagtcattaactctgtatttcttaggtgtctttctgggaccagtccattgattgtccccgggaactgagaaggatgacatagccaagaaaacttaggatgtgctgtgttacaaaaagagtgaggctacaaagagctttcctatgcctcgagtttcttgtgaatctttctgaagaactccttagggtacagccattccaatgctaacagtctgtagtatacttccaagaaagtggtgttgttctctgagggtaaaatgaagggcctgaacaggaatcattttcagcttgaattaagagggaaaaaaagccaggcttgtttggagttagaataattctcaggaagggatgcaaagatggctcagtggttaagagcaagtactgctcttgcagaggtcctgagttcagttcccagctcccactttgggcagttcataactgtctgtaaccccaggtccaggaatctgatgccctcttctggactccacaggcacccacacatgtgtgaacatactcacacagacacatgcacaaaaataaaaataaatcttaaaagataaaataggagcagatcaaaaggcatgagaagggtgagttctagttactgagacagctggctagctgcaggcatcacttttacttcactttagaaactttgtgaacactgtgtctttgtgtgacgttgtaaggactcaggtctgaacgtcactagagtatccatgtgtgctttgtttatggctcagatgagtgggtagaaaatcccacagatatctccttagataattggtttctatagcacgagtttcagagatcttttttttcttctttttttatttgaattacaaacaagattgaattacatgagaatcccagttcccttttccctcccttcctcccctacagaccccccaaaactaaaaccctacctatcacatatcctttcttgtaatctacacctgactcaacctttctgctccctcatgacctctgcatctttccttttcttcccttctcattctcatagctccctcccccctcttcccatgttctcactttgctcaggggatggtgaccctttccccttctccaggggacaacgttcgtctcttttaggatcctcctagtttactagtttctctatcagtatggattgtaggctggtaatcccttactctatgtctaaaatccgcatatgagtgagtacataccatgttggtctttttgtgattgggttacctggctcagaatggtttcttcgagttccatccattttcctgcgaatttcaagattccattgtttttttctgctgagtagtactccattgtgcaaatgtaccacattttctccatccattcttcagttgaggggcatctaggctgcttccagtttctggctattacaaatagtgctgctatgaacatcgttgaacagatgtctttgttgtgtgaatgtgcttcttttgggtatatgcctaagagtggaattgctggatcttggggtagactgattcccattttcctgaggaatcgccatactgatttccaaagtggctgtacaagttggcactcccaccagcagtggagaagtgttcccctttctccacaccctctccaacataaactgtcattggtgttttttattttagccattctgacaggagtaagatggtatctcagagttattttgatttgcatttccctggtggctaaggatgttgaacactttcttatgttgaggtctttggtccattttgacttaagttttgtgcaaggtgaaggcttgggtctatctgtagtcttctacatgtttgcatccagttatgccaacaccatttgttaaagatattctatccccatcaaaatcccaacacaattcttcactgaccttgaaggaataattctcaactttatatggagaaacaaaagacctaggatagccaaaacaaccctgtacaatagaggaacttctggagtcatcaccatccctgacttcaagttctattacagagctatagtccagagatcttttcaataagtatatttttcttttctaagaagccaagctaaagggctggctgcagagtgagagtcctggtcaggaatgctgtctggagttctgtgctcagattgtatagcatgactctgtggcaggggttctgtttctctgttccctttcctccttctggggaccaagctgacaatgttaaccccagtccttcttccatccatcagtctgtctccactgacttcttcaatggtcacatttgagttaatactgtaggaaagaatgctttagaacacagtgtgatgactgcttttcagtgggagaggctactgacttactggcataagactttctcctgcttgggaaaatcagttatcactcagatccatagtacagctttaggtctgcataagactggcaccatttctggggactggtgggagatgtccttctgtaaatatgtttctcttactggttgatgaataaaacattgtttggccaatagatgcaggaagataggcgggacgaggagatgaggagaaggctgtggagagaggagagagaggcagaggagactccatgtagagactgggaagataggatgtgctaggtgttctctggtaagataagaccatatagaaacacatagattagtagttacggattaataattaagagagagctagccagtaagaagccctagccattggccaacagttttataattaatatagcatccatgtgtttatttggggccaatctgcttcgggaccaggcaggacagaaaccgccatcttcagggggtctttcatttttcatggtgctcttccagtcagacttcagtgtaagtggggaagaggagcaggggtcctcagacatgccatgcatagggagaagcagtcatgtctcaatgtgagtcccagaatccagtgggtgaaatcatgctaatagctagtatttttgtagtactttctaactgacaagtcatatacacagtattcttgtaacatatgtttgcatgtgtatagctgcatagaagaattctgaaaacaacctgtactgggaggtgttactatcttcacctcctttcacaggtaagctcctccaagaactatgtgaccctgacctaggcttgtgactgacccagatcaaactctctgccctttgactgcttgtcttgtttactttacattcctgtttgtcctaaatagttccccagccccaaggttacataacattaagttgtataagagcttgccttggccttgtgtagacttcctaatagtctttctgaaggaaacagtacagtgtattttcattaagcagaggttgcttgctaagtgacagaggaaagcgatgcagaaagctgcagagctattctgcattcagatggatacgagctaacctctgcttcccctaatgggcttcagggccagtagtgatgagtagaaatcaagaaaaggttaagaatgttgtaaatgtggggtgaagtgtgagatctactgtttcttcatccatgccctagttgtctctccagtctgcttctgagttgttggagtttgctttataaaaccatgcctccttctgtagagtagaatgtaatgctcactctttgtgtatgagaagctcaggtctgaccattcctaagaggcagccactcactgttcttatttaataaacgaggatactagagtttggactagagaaacctcagtccctttaactcagcagacctaaccactgcctcctagtgacccacatggaaagtgccagccagctgtgaaatggccaccagctgcctggtaggagctgtgtatgcaatgtcaggaagtccttttaaaacatataaaaatgaactttaatcatatctttaattaaacactaatctgtctaaattattattttagctcacgattaatattttacaatggtttaaatttttagcataaaacatcaaagatatgaatgagacgacttgcattcttacactaaatctcttaaatctaatgcatatttgatgctcacagccagtctcagagcagctatacttcacatgtgtgaggatggttcctctcttggccagcactgtcttttactaataaccttgactttgaaggaatcgcaggtcctttgtccaggcccaaaagtctaaaaatgagatgtttctctgtcagagagtaccagccagctcattgtaagttgcttggattcttggaattatatggttcctgcttcaacagtagactctaagggtaacccacatgtgtgtggtctcattcaagccatcccttgaggctttgaagcttctctgctgtgagtctctacggcacattgtggtggaagactgagaaggagcagcccccaattcatattgatcaataacggcttctcttgggacttaaaatatcaaaaaaggagaaaggaaaaagaaaagaaaaaaagagaaaagaaaagagcaagaaaagcttgtgatttttatgggcaaagattacagaagtccccagtgtgtcacaaggtacaacagagtgtttaaaatcagggtatggggaaaccatttatgtgaatgcatgattgaaatagatggtggcttttgttactaaaatgaaaaatgaagaaatgtcagggttcatgtcatacccctgcccattgctgcagcagccttccactcctgttagagagtgtgggtgtccaaagtatttctatgaatctggtgaggacggtgacagaacataccagaatgtccagcaacgaaactgtgtgataaactgaatagccatgtgtgttttattttctttagttggctccttcagaatgaagaccttctaaggattgtgaagacatggaaactaattattataataaatttaaatgtttggtgcatacttcctcatagcgtcttcattggccacacagtgtttttatgaaaggacatcggtatgtgcacaaagctggtagatctctgcttctcaactttgttctcttttgagacagagtttcactctgtagcttaggttgaccttgaactcatggcagtcctcctgtttcagcccccacccagtaatgaacttcagcgtctatgtcagctccctgggttctgttcatccttctgtccaagggcgcccacctcctgcactggggtccatccttctccccaaggctgtccatctgcactgtgcttgggtactttccaacatggctgtgccaccaacttcctacatgtgcagacattttcattctataggtcctggattctgacctttgacttttggcctctgacctctgatggctcacttttcctttctcccattttcttcactcctgctgaccttgatgaattgtcatcttgtagcccttctttgtgtctctttcctgtagttttcttttcagacctcctgtgatgagcacagctctccacttataccaccttctgctgctctgttcataactttgttagatttcctctattaaatatgtcgtatgacattattttactcctttatccaatacctagtcttcttcatcctctctatggacttgggagttaatgccctttgcattatcacagagtgcaaacgtctcagcattcagggtttcctgcccctcatcactcatatccattcttctgtcttcaggaaacccagacccagctaatactgaccattgtcagtgtgtgagagtttccttccagactgcattgactgaggccctcagcgaggcttaaggataaaactgttctggtgcactgaaaatgtcccatttcccctcttctcttttcagtgtctgcccaacttcccagacttacctgggaagtgagagcatgtgctgtgaccccacaactgaggacatagcagaccattacagtacttctgtgagcattgccccacaattgtgctcacacacaccacaattcctgccggtcttaagtccacagtggagttctctgctgtgataacacagtgcaggccagagcagagttccacaggaagcattcttaaaggagcctggggctttgtttacattctctggaaggattgtcatccactttccctgagcagatatctccaggaaaagttaatgctccaggccagactgccttgtcaagtacaagagtttcaagaatctcaggccgctactctcctgggtgcctttgtagttgagctgtcctaagacccagagggagatggcttaaggcaggaaccgtccagttaaaggctaatgataacatgccagtcactgggaacttcatttacagacactgtcatacgttagacaaccaacacttcatcctgtatcttgagtcagtccagcaggttttcactttgtctcaaaggtcaacttggtatttgggttgttggaggatctcaaaagctttcaagttcaaagatgctctttgtacaccaggcagagaagcaagaagaacagaagaacatttgttctgtgttctcatacctgtttccggcctgcaggctccaacccaggcagcacttggggagtgaatcttggcttaagaaggccgccccttctcagggacttgtcaattctgccgcttccttcctcctctgctttccacagaatgcagtctccccagccagtctgctggatagcacatgggctttctgctctcacccttcctgttaccttcttctgattgacaggaatgatggttgattcacacctttcttatgactctgtccactgggagcagtggggtaccaatccataatctcctgctcagacagagaactgactaggacaggatcgtgtaaagagaggttctttgtcctgtcttgtggcccttaagcctcaaataagcaatcagatgctatattagttataaactgttgtctggtggcttcttattggctagctctgtcttaattattaacccatttttatcagtctatgtattgccacgaggctgtggcttacccagtaatccctggcatgttgttactcctccagcagcatctcgactctttctgtctggcccactctccctgcctttcccagaattgtcctgatctcctagtcctgcctatcttccttcccaattgaccgaatagtgttttattcatcagccaataagagaagcatatatacagaaggactatcgggggagcaaggaaaattccattagggaatttctggaggtccaaacctccggagctcctgtctgcattgaatctctacagaactaagcatttgaataggcctgcaccaggtcggagggcaaggtatgtaagtaaccagtggggacggagagaatcaggaggtagcaggcagagggtttgactggaggagagagaaatggactcatggccagggaagcatggttaggaaacaggaagatgccaaataaagaagagagtccagttttgcagcatggaactgagaactctctaaagatgacaagatgcctgtgtttggtctttagcgccattgggttgctaggagtttccaagtccaccctcccccactcaggccgaactgaacctcacggctgccctggcttggggctgagacatgctgggccacgacaaaggacatcccccatcaggatcacatgccaatcaacttcagagagggccttgacatccttcttccagtgacatcaaccatgtcctttcttagaataggcagctattaccatgtgctgatctctgattatcacgtcacttcaggaaaacagtttcagctggctgtggcttcacctgttcatgtataaagtagaaatagttctagaaactgaacatctcttaagtactaaatgtaatgtattaagaacttaatacaggacccagcacacaataaggatgaactagttatttaggtgttactgtaacctaaaaacatagtatctcccatccaatctgaagctcagcttctgggtgtaacgttaataagggatgagaagtgggcagccattctctacccatgccactagttaaacatcctatgatgacagtcagctgctgggagacccggatctctctacttaagtagaagaaagagcctctcattgtcctgggacttgccaaataggctaggctagccagccagtgagctccaaagtccacctgtctccatctcccaagtgctgggaatacgtttgttattagtcacacgtacctgctagggatcaaactcaggccctcttgttcatacggcaggccctttaccaatggagccatctccccagcccagcagtgtgatttgaattgtccgcttttccagtcttcactgtcatgtaaatcaagcagaacaataagtgtgaactacagtcacacttattttttacacactgctttggacacaatgcactcagaaatcccgtgctaaagcgatgcagagcaaccaggagtccttcccatcccgtgtgggaagcagagccccaggaagcccacaattacaaagcccatctcctgagatgtctgtccttagcttgaatttcacacggcaagctggtaatgtctcctgccgtaaaagcagaaataaaaatcttctttgtttacgggaaacatgattttcgacccagttacagcaaagagcagcactgcaataacagaagccccgtggcgcagaggacctgctattcctgccttcacccttcactcctttcttctcattgttcctctccctctgtcgcaaacctatccagtctagtttatattagccagctgccactatgggaagggctgccctggactgtggttctgtatccggtgtcacgccattgaagaaaactgactgtcctctcccagcagcattcaaattccaatagctcctcagctaggggcaagaatttgtgcccactcctcccaccaccacaaaccccgtgctgagatttttgtctgacttgagcttgtgcgtgctgacacagtcatcgtgagttcacatatacatctatcctgttgtgtttgggaaacactcctcccttaaactcatctaccaccctctgtttcttacaatctgtccaccccttcattaacatagagacctgagcaccaaggggaagagggtgatggaaacatcccatttacggtggagtactctgaagtttcttattctctgtacattgaccagttatgagtctctgtgttaaaaaccattgtgtagtttcaaagaaaatggcccccaaagggagtggcactatttaggaagcatggccttgttggaataggtgtaaccctgttggaggaagtgtgtcactatagaggtggagtttgaggtcttctttgctcaagctatacccagtaagtcagaccactcccttttgcccctggggcaagatgtaggaatctcaactctttctacagcaccatgtctgcctgcacaccaccaggcttcccgccatgatgataatgaactaaacctctgaactgtaagccacccaattaaatgcttttcctttataagagttgccatgctcatggtgtctcttcacagcaatagaaatcctaactaagacagccacctactgatggccactgctgcttgcaagtcaccagtcctgtgtctgctactgacacttccaaagttcatcccatgtatcaattctttcttaaagcaatcaactacttctgttgagatgactgtgggactattggcagaaatccagaggttttgtacagtagcaaacttaacctatctctaattactggaagaaaatgtggcatatcctcaatgcattcgctaagtacctatcattgagatggcccaagaaagtgagcctccgagaatgtttttacttgacgccacagaggaaaacacaaccacagggaagttcccaagaaatcacaaacactgagctgcaaaattttcacattctgagcaaaatctaatttctactcgatgtctttcttatgaaatccattctgagatattactggtttcaggaacccattctgatgaacttttttggaaattcctggggcaggagtcatttaagagagatgagtcctgctacagagttgtaaaaggtttgtatttgtgcttgattcttacatggataatatggtgctatgtacctgtgattcatggttgagggcactctagtagagctcctgtagagaacgctacctctacagtggcaatgtctctttgtcattccttctactccatccatcactggggatggcttcgaagtcttactatatgcagatcgtgagattatcttagactgagtgttcagttgctggaaagagacaccatgaacttagcaactcttaaaaaaaaaggaaaatatttaacgggggctgacttacagtgcacagggttctgttgctgagttgttttcttgtcccaccaggtcccactgccacttcagccccaaataagcacatacagatggtatattagttataaaactgttggccgatgactggggcttcttactggctaactctgtcttaattgttaacccacttctattaatctgtgtatttccatgaggtgttgacttaccagagaatgtctggaccttctacttctttgtcgactacatggggactgtctttggcaggctctccccacctatctttcccagaattctcctcatctcctagtcctgcctgtcttcctacctcattggccagacagtgtttatacagaaggacatcccccatcaggctttatccattatcgtccatggtgggaagcatggaggcatgcagacagataggatgcaggagaggtaactgagaaggctacatatggaccagaagacagcatggggaaaaagaggatactgagcctggcttgagcacttgaaacctcagagcccaccctcagttacacactccctcccacaaggtcacacctcctaaaggtgccacgccctggtgaccaagcgttcaaattgatgagcctcggggtccattcttattcaaatcaccacaaagatccaaagcccactctcaggggagtttacaatttagcaaaggtcacagagcacacactctgggtgttaggatccccgtgaggtgggtgtttttcctcaagggatttactgatacactgtttcccagagttccctgggagaagccctgatggctatttcactgtgtcactcagatggacattaacagagtcctcaaggacttgcattaacaagctgtgttaagtggtatttaatctctctaggttcatctctgaaaggtccaagtttccattctagctgacatgagttattacaaatgaaagccactaacccattactacaaaattattgtaggttttccccccctttttgctgattttgaaggattcccagttaaatagtgtcctgtagcaactaattttctgccttaattctgtaagtccatatctccccttggattcaagcagcatttctaaatgtacttggtgaagactctttggaattctaactgtaaaatctcagtggttaaataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtacatacagtgttttttctttgtgtgtgtgtgtgtgtgtgtgtgtgtgtgtgtgtgtgtgtgtgtacttggttcagaatagaatatccaatgccttcctctgttgccctctgctttgagatagggtctctcattgcacctgaagtttactcttttggccacacttggcggccagtgttctcctaggatcatctacctgtttttaactgagtcactgaggccataaacacatgtgtgtactagggactcaaactcaaacccataagcttatacccagtacgccctctccctgtcccttttctgagtgtttgatctaatgtccattgaccctgcagatagagggggttgcctgtgttctctgaacagcacagaagggctggagacagaaagtctatccggggtagatgaatttcttgaatgttgacatatagcgttttaaattaaggcaatcctccagtctttgacagcctttagcttatgttaatgaagacactggagggttttctagataaaagattgcctgcatccctcagtgtcaatacttctcacttcaccctggctccttcatcttccagaaacacataccctacctccccgcctgcgacctagcatgccaaacaccctcactgggcaggcatttccctcaaccaccacacatctccaccaacacggatccatttccttcttcttgccatgccagtttctgcccacacaatatcttgaggtcttcccttgtgacccttttggcacaacttccatcaccttgtcctgtgtttcccattctttacaaacttataccatctaacatagctttctgtattaatggtctttcacacacctccagaatgtctgagtttgtaaggacagttattgaattcattgcaatatccccacacgtgccaggctgtacgcagtcagtagattccagattggtgagtaactaaatcaacttgaaaaagaattctgggttgtgctcctgcattacagggggctggacttggggtcatactgctgtcatcgaatcatgcttcagtgtgatggcccgccctgccctgaggactagactgagaagcagtcatggggcactattcatagtgaccccaggctgtcatcctgaggctgttgccatggtccctcacatctttatgaggccctgagggtgagagatctatgtttcagtgttggaaagcctatatctatttctccgaaatttagtttttcttttcttttcaacctggtgcattgagattttttttttgttttctggaaaggtcaattctgtctccactttcgttcctcctcaactgacagccatctggaatgtattagctgcttcttcccagtgctgttcttacttctacatttgtttggtttttttccccccttaattcgtattcagctcatgttcctgccttaatttcattatgcaacaatgaggtgtgagtgaagatcgaaatacttcccagctcagatcttttctcccagctccctaggcaggtagcagacactgaactgcttgctctctgggggggaaaaacacaatgttaaacactgttacattggcatctacaagcgataaccaagtgccttgggagtatccgatggacagatttctctttacatagttctcttttctcaggaccatatttctttctaagtcccttcttgtgcttccggaacaattcagtttccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccaacaaattcatctgagagaggaggaggggtttattccgcccacagtttgggggtgcagtctgtcacggagagaaaggcatggcagggagtggttctgactactacttgttcacatctcagtggtccaggaagcagacaggaagtgggcccagctataagtctcaagacgtgctttcagtgcctcacttcctctacctagagatgctgttagagaaccagcagcaccagctgggaaccgcatagcctataaaggatgtttcatccaagagccatgacatcagcatacaaactcatcatttattttatttctcgggttagtatcctgagatgatgtttaaaccatgtgggccagggagatggctgcctttgcaaagtacttgctgtgaaagcaagaagtctggagatcctcagactctccataaaaagtgaagcaagcacttgggaagcacagagaggggagccccaggctgggatcaccagagaaaacctgcctcaatacagaaagtggagcacgatggaggaagacacataaagtcaacttcaagcctccacatgcatgcactcacacaaatgtgtacacacatgcactcatgagagcacaccacaaatgcatgcactctcacacacatcaagtgtgaacacacacacacacacacacacacacacacacacacacacacacacactacatcacatttaaaaaacaaaaacaaaaaacaattgatttttgatgtttcaggcttatcttcctccgaccacaggtttctctggaatatcgtggtcttagatataactctaattagtatcattgtttatacacaaataaaacattaatgtgttgagactgtgaaaattaatgggccttagtgggtatcccaaagtttcagctgtattcccttcctaaactgatgaactctgagctcagttaaagacactgtgttagggctggagagatgacttggcagttaagagcactggatgttcttccaaaaggcccgggtttgattctcagcacccacacagcagctcacaaatgcctctaactccagttctaggagatctggaacccttgcacagacaatacatacaggcaaaacacttgatgcatataaaaataaataaatcttttaaaaagaagatactacttagagtgattaggatgtttaaggaccttgacatttgtactggctcacccaggacagtcacatgactgttacagtagacagaccctataccaggcggcagtttgttgtttgcttggttttttaatgaaataaagacatttttcaggcaaaaaaatttaaaagaataacatatactttttccttagctgaagttcaagggtgtcagatgggatatttgaaatgatttcctgattatttcccgtgggaatatgggaagctgaagcaaaaagcttccaaattccacacaatgggagctcaatagttgtggcgagaaacagactatgcaggagacctccatcttttctgacagacagaaaccacatcctttgaaggagacctccgtctttctgacagacacatcttttggccttttttcccactctggaggggtgcgttgggggtatgtgaaatgctttgggatctgagaatctcactgaaaaatctgaagggtccttctaccctgagggcaattggttttaacttgaaagggacaagacagctgttaggcagaactcagggcccctcccttctccaagtctacacatcttaccttaatttctggaattcttttgagaagacacagggtttctgatacacactgtatgaaccggcggccgtcagaaatccagacctgatgttcttcaagctgccccctttcctggtagcacccctctaacagcatcctagcctttaaaacaccggaaaatatggaagcaatattcttaaagcgcagtcagtcagcatgcacacacatgtggtaccttccccttcctctgagcagagttaccatctgccacacacacacacacacacacacacacacacacacacacacagacagacacagacagacacacatagacagagagagagaggccatgcccatgcccatgctaacatccattggatgtggaccaatgtcatgctaaaagaaataataactgaataaaatctcccatgtgcaggcaagattccagaagctgtgtgaaagaattcacatttatctatatttaatttcaagtttgcagagagcacgacctatggagctatgaggcacttggcaattagaatgtccatacaagattgtctttcaaatatgcatggtttactcacacaaacattacttatgctactgtgctcatataaaaactaaacagatatttgaccaagcagggaacagttgattggacagaaaatgttggggaatcttctctggtaaggacactttggaaacttgcaggctctacccacgtctgcagggaagtccttcagctgtggcaggctgggtggatggcagtggtgaaggtccaagaatcccctgagagcatagaccagcagctgggactgacgagtgggcctgtgtgtgcctagagataatccagaagttcggtggttaccaagacgaggctgggcacagagttttacagcttcttgctggtgggtaacaacacagagactagagaagccatctttccagagaaagccagcgccatccttgaggccatttctaaagttgctgtttttattatttcactgggcagtagctttggctatcagggctcacagcttggggttggttcagtagcatatcagcgtctccttgggggtcacttggttagtgtaccaaggcatgtcctgggctaagggcttatgtgagttgcctggggctgccactgaggcctagctcctgacagagctgcctggtgacaagcttgggcattgtatttcaagtcacacacacacaaaaaatggctttttaagtcacacaaaatagcgtgttcctaagttctttgtcttggcctgaactttctgattctttaggactttctagtcctgtcttttctgccatttagatacttaccctttccaggtagctatttcagtgagaaatttgggaacagtaactttgaattatttggttatgtctttaaaaagaaaaactttatggccatggggatagtggctcaaacctgtgatccaactatttggaagaagaagcctgagagtctcagaatacagaaccccagcagggcccctccaggacagggacacagaaccccagcagggcccctccaggagaaatcactcccagtcacttttagccttggagaagccagagaaaagcatactccggcagaaaatgagatcagccctttctttctcttatcacacaagaatgggtgtgatgtgttaaaaatcagagaagtgacatgtgtcctttactccgtgtagtatctagaaacaatgccatcttgtttcattcaggttcttatatgcgtttgtgttaacacttaggtctatgtgtggcctgagtgagttcttccccctgccactcacttatgaataccaatgtgcatcattttgtgcatgtgtatggatacacacatatgacaccacatgtgtcatggcatgtttgtggaggtcagacgacaaccctagggagtctgttctctccatccatctcatggctcagcagcaggcttcttcacctgctgagacacctcacggtaccccacaaatatcattttgatgccgactttctagttaaaaataatgtgttgtagttcacatacaaaagcaccagctttggattctccttccttccttccttccttccttccttccttccttccttccttccttccttccgtccgtcctccttctcctcctcctccccctcctcctcctcctcctcctcctccttttcccttaaacagcatactttttctttctggtagctttgtaaattacaaacaatattttgagctaggtgtgatagcccaacccttgtaatcacatggaacgtgtaaatgaaaatcccacatgtacaggatgggtgggtggacacctgagataggaaagtgactttggactgcaaacaaatgaaaacatattatgagcaggtgattcctcagagtgagcagtaaagaacagtattgtgggagtggggaggatcttaggggtaggagaatagttcagtcagtccaaagcttgttgaacatgcatgaggaccagagtctggtgtgatgggtgtgatggattacgcttataatcccagcactggggaggtggaaacaggaggattcctggggcttactggccagccagcctagacctgtgagcctcaggctgcagagagaggacagaacctgagggaaaaaactggacgtttacttctgaggtgttacttgcactggagaaagtgaacgcagctctgggtaccacacagcagaagaggagagtcttagggaggcagtagcctgacttccgcctggttttccccagatctctgtcagcatgcagaggtagacactgagcttctcagacagggcttcgagttcctgagcccataggaacttgtaaccacctagctcttgtcacagaacaaagcttggcattacattagcagcaaagaagatgaaattaacatttcttagaatcctgaccactgtaaattatcactagcctcgggtttatagtctattgagaagctcaattaatatgaagaggtttataagatattttccttttgtgtatctggggatgtgactttatttaataccagagtgtgaggtggcttagaggttaagagcactgggtgctcttccagaggtcctgagttcatctcccgacaaccacatgttggctcacaaccatctataatgagatctggtgccctcttctggtgtgcaggagcacatgcagacagaacactgtatacataataaataaataaatctttacaaaaaaaataccagagtggaacatgcctttaatcccaggactcggcaggcagaggcaggtggatctctgtgagtgagttccaggacaggttccaaagcaatacaaagaaaccctgtcttcaaaaaaacaaaaacaaaaaacagagtgaaagaagactgagacctaacgtgagttcataagaggacgggctccgttcctctccttctacagtgctgtcatgaattgggtcagtcacactcaacactcacagctaggtcaacttggagtgaaccctaatgtaagaatgtattgatttaatcctttagctcatggtggctgagatcgcaaatcccagcaaagatccatcaagtggcaagtcctgtgtcttgccttcctgggagctagtcccaggaccagggactttgaagcagggcatgagaacacctgcagcaagtgtgaacagcactctgcaccaaggaggatgtcatggagacttgagcttatgtggctggggtgtggcaggcgccataagctaatggaggaagctgaggaggaaaacctctctggccaggagtagacggtgtgaatcttacatctgccagagtagaggacggagcaaaatgataggaaaatctgggagtcacacacgggggtctcctctttcctggtcccacgtcatgcctgtagaggtgcactcttgcgttctttcttcttgagtactacatttatctgagaagtccacacatgtgtacagtgtaatgtgaccacactcctccctttcgtctcttctccctgccaccatttcccctaactcacacctctgtcccattttcatatcttcctctcttttctttaaataacccattttgccccactttgttcacttagcatcatccactggcgtgtggacaatctccctaaaagaacgattctccctccccctggagctgccagctgccagctgtccctcagttaggggtggggctatcagctaacgctcagggaagtatctcctgatttttactgtagttttgtgggagctgcgttgtccacttgttcatggtacttatgttttaactccttcttgcctactagtgcgtttccgtgaggctttctcacaaccttacttttggttaagccattcctccccctcccccttccccatccccaatccccttgctcccgtccagcttgacactttaatccttgtcccctccctccttctgtgtcagacatatattgtgatatcccctcccaatggccatgtcctcccattgtcctttcactgctctggccttcctctctgaagtgactgtttctcttacgccccccttgtcacacacacacagggctcacactccgctgggagacaaagacatgcagcatcagaagatgccagaatttcctcagggaggaagaacaccaagctcgtcggtccgattcagttggatgctaaggaaaacgaggcatcaaatattgatagaatgctccccagaaatgtcctgtgatcgcttgaagctgatcgttcactgttctgtaaagaaaacaacagtggtgagagtgaggaggcagagccctcggggtgtcttcatctttggagctgcagtgtcttgagtagtttcttagcaaagtcagcaggaggtgacagagccacagactgtcagacttgtcagaccccagcttcccagggatgtcacatccctgagtctccaggtctccactttcctcaggctgccagacttgtcagtccccagctccccagagtgtcaaatccatgagtcctcagcttcccagtgctgtcacagacatacatccccggctccccagggctgtactagtgaacagtcactgtgtgactgcctgcttcatgggttagaaggaacacatttctgcatagggtccagacctgtggctgtgtcagggagctttttctaatgttagaggaacccactgtatacgtcctgtacattaaatacgtctggctgctgtggaccgtcctctaagtcaccaaactccagtagtgtcgagggagccaagcccccacagggttcacaatggtctctgcagttttcctacaaatatgaaaaagtaacttgtctttcactctcattcttttgtgaatttgcagtagttttcggtggtcatatgatatagccacaattcagaaacggctgttaaaatgatagttcccctttccacctttcatcccgtcaggtcacagtttcttcatgcttgaactaccaataacaggaaacacttaaaaacacaccgtcacaaaagcaggtgtgagaagccaggtatcttctactaggtcaaacattaaagagatgggtaaatggagccaggagacagctcagtaactagcatgtgtgtggctcttaattctgtcctcagaatgcccataaccaaaataatctagtaagtatctcaattaatatcactgtcgtatcttcttttgctttggaaggtctttttatatagacacattgtttatgttagagcttattgtcaattctctccttctatgaaagttcgggagattgaactcaggttgtcaggcttggcagctgacaccttaacctacggagcctctctcacaggtcccagggagcagcaattcttgatggacgtgccctacttcctatagcagctgcaactgtcgatgcaccctggataaatgaacaaatgccctctaatactttctagatgttggttggaatctgatgtagtatacattcttcctgtcctttaacacacacacacacacacacacacacacacacacacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgctctctctctctctctctctctctctctctctctctctctctctctctctctctctctctcccaggctctcagccaccagagcaagtgggaatgccaagatgaggtagaaaagggctctcaaagccctgtgaggtttacacagaaaacaatagtgagcatcacatgtccttctgaaactatgttctcaattccacggattcttgagatcattgatccggacattctacccacagggagcttttctcagaagccctcttacctcccaacacatcttgaaacaacacacccttggctcctccttggttttcaaatccatcatatcgttattacagtttgtttccagctaaccagcccctgcacgcccagcccccctgcatttccagcctctgcatgcccagcccctgcatgccctctgactctcaagttttaatgtttgatgtaatcctcaggacagccctgggaggcagagctgtcagaactattactcttcatctgcatgttgaaaaaaatcacataactgttaaccgttaattcatgaacctactcaagaaaatatttgttaaatgcctgcaaagtgtcggacactatggtagactccaggcacaaggaaggatgggaaaaagatgtggccctggtcttaagggagctgagagagagagagagacagagagagagagagagagagagagagtggtcaagaggggcacaagcatcccattgagaatgaggggagggtgaggagaggaagaggtcagcgagcaaaatgggcagccgaggaccagcacacagaccctgtgacggcagagtcgggtgtgcctgaggcacagagggctgggaaggaggtagggcacacagttcaggatgaaaacatgactagagtcccccccccacacacacacacctatggaaaggccaggggttttattcctgatttaggataaactctggagttttaacagaaaggcagaattgtgcttctaagcggtgtctatgtgcaaaggcggggcaggcaccaggggccagcagtccagatggacacatgaccatgcaaaccccactcactgcagctgcgtcacctacttgtaaagcaatggagacgtttgattcttgctcgtctatggatggggaacctgagccatgaggaaatgctccttctggggcctttggttcccagtgagtgtagaaagtacattctgtgtgccacagggtcacactagctgacggaggtgtaatgccactctcagttaggtttctcgaatttcccgatactgcaggcactcgaggccatcgacaaggctcttcagctgaagcccagggacccaaaagtcgtatctgaactcttcttcacaaaaggaaaccagctgagagagcagaaccttctggacaaagcttttgaggtaaggccaactaaacagtcattaagtttacaggtttaaatgaatatcacagccaatgagggagtctaggtgtaaactccagtcattggtggtctgtagcatgaatgttgtgattaattgacagtgctacagactcgcttcctttggcctctggtttttgatcacacacacacacacacacacacacacacacacacacacacacacacgcacacgcacacgcacacataaacacacacatacatacacacatacacacacactcaccacacacacacatacacacgcacacacacatacacacacacacacacacactcacactcaccacacacgcacgcacacatgcacgcacacacattcgcatatacacacacacacaccaccgcctctgtgttatctcttaaaagtatggtagatggggaagcattcaaagctcccaaattctggaattctgaagagacacctacactgtgtggtgatatcttgcttgtacaaataaagcctgtctgggggtcagagaatggagcttgtcactagctaaccatagaggtcgggaggtctgtacagacagacaggaagtgaggtagctgggagaaacaggatcgatctctgctctgctgagacgctgaggaggtaaggtgtggctgtggcttgatatctcaacatttccctctatgtctgacttcaggtttttgttatctagaccaagtatgagctccatgtacaacaccgtctgttttgtcttcaagaagctcggtcacagctggactggagcccaagtagctttgggcacttacatgtctgtgacacctgccatcacctctagacttcctcttatccccagggctctgtctttcctgggaagaccctccagaccatccattcctgcagtgacttttgttctaaagcttaataaatatcacatcatgggtggctcagtgggccaaggcacttgcctccaaggctgaccacctagaacctgcttggcggaaggagagtactgactcctccaagttggcctctacctccacatgtgtgcagtgacatgcatgtacctacacacacacatactaaaatgtttaaaaacattcctatgttagcaggatatagagatataactggagacagagaaaataggatgacaggttcaagcccagtgagttccagggtaacaaggctgtaatgagagactctgtctcaaaaaaaaaaaaaaaaaaaaaagaaagaaagaaaaaaagaaagagaaatgaagaaaaaattaaacactccatcattaaggtatcaagtcatttgcccccaagcagctaaaattacagaagtgtgccaccacatctcagctttgaagagcttccaaaaggcagaagaaagaggtgttgtgacccctataaagcaatgtgagcgtgttgctttctttagatgtttagcaacaggttggaggttgaagggcctgggctatggttaagctgttagaagagcaccttgggttctatggtttcctttgtcttttcttcttcttcttcttcttcttcttcttcttcttcttcttcttcttcttcttcttcttcttcttcttcttcttcttcttcttctgcttcttcttcttcctcctcctcctcctcctcctcctcctcctcctcctcctcctcctcctcctcctcctcctcctcctcctcctcctcctcctcatccttattgagagctggggataaagcccagggcctcacatggactgagcttgtgctctgcactgagctactctccttagattctgtaatgctgacagcagtgctcctcatcagctcatttatggtgaggaaggctaataagcacagccttcctgcagagccagagaaacgagctgtttcagaagtccctgggtccccaccagcaggccagagatctgctgtcactgaagcccctggggtctctccacttcagaaccatcaactctaaaaggatagcagactaaacctgccacccgctaagtggccgttagcgaccagggcctccacacaggcaggggtttgcacagttccagggcaccttagacactgtgtctcatgtcctaacatgaaactttccttctctgctagagctacgaagctgctgtgaccctggatcccgaccaggcacaagcatggatgaacatgggtggtatccgacacatccaggtaggggtggcactcactgtgttcccatcctaaccctggctcagaagccactgtttgtagtcagagtttctctcccacctggtccacaactgtctagccccaagtgagacatagagaattttattagttagaaactgtttggccgatggttagggcttcttactggctagctctctcttaattatgaacccattactgtaaatctatgtattgccacaaggctgtggcttaccagtaacctggtatgttactccttcgtcagcatggtgtctctctccaggcttctcctggttgggtagccctgcctatgctttctgcctggcttctggccaatcagtgttttattcatcaaccaataagagaaacatatacagaaggacattcccatcaactgttcatcatctctcttaaatcatttcaatacttaaaacaggcattttgaaagtaaaattcagaagagctatgttttctgaatagtgaatatcacgggcctgtttaaatgtttataaactcaactccacgatactgtggatcgtaaggaaatcacatgtgtgagaagaagggttaccagacaatggctcaggtctgagtgccctaacctgtgaagcctgccaacgccccagcaataccagactgttaatctaaatacacccttactatttcttattttttattatatgtgaatgtggttgtgggtttatacgtatgagtgcgatgccttcagaggtcagaagagggtgtctttgggtcccctagccctggagttaggggcccttgtaagatgcccagcacaggtgctgagaactgaacgtgggtcctctgtatttaatgttaggaagctctacccagccccactcctctcattccagaccctggccttgagaaagcctgctatcagtggctcctccccctgggatgctcaagaccacacctacaggctgtttaagattgggtcctcacctgccacctggttctcccttgtggtttctccccttcccctgggagcacccgggaatgctttgctcagattaaacctgattttacctatttggcctaatctgatttagtgcatcagcagagaaacacttttcatttataactttctcaggtggaatataccagaaattaaagttcggttgttaatttgaagtagaaaggatatacctgagagcattcaaaagagtaaatagtgtaattatttctgtatttaaactcagagctgtatgttggtaaaacagagctctggagattgaagcaatatctgctgggtataatgttttcaaatttaattgacattcatttaaaagaaccagcctttgtcactgcagacatcatggattagcttgagcaataggaaactcccccatccacagtgaaacaattcaatgggtaaatttgaataatgtgatctgatataaatgtgtgtagtgggcacatagcttggcagtggtcattctgacaccaccataaaagtctaggattatcactgaaggcacacaggaacaatcctgaactttctgtgtcttttgcaagagtgttcatcactggagaggtggctcagcggtaaagagcatcagctactcttccccaggtcctgagttcaattcccagcaaccacataatggctcacaaccatctataatgagatctggtgcccttttctggcttgcaggcataaatgcaggcagaacactgcatgcataataaataaataatagtgttcatcacaacgtcacccatcctggtcctagcccctgccctgtgcctggggtatagagctctgagggatatggaggtgaagaattgaaataaggctttgagaggaggtagcacaggaatagggaaaagacagtgaaggttgtggctgccccaggaaggaagggacatagtcacacaatgtgtctaaggtcagtgctgtgacctgaagtgcctcagatgtggacagtcaagtctaactgcagcccctgctgctaattgtatggggtatttttagtgtgtctgcatttggatggtaggccattccatgaggtccattacagaagcctctcttgatggtatcttgtctgttcagaaagtgtcaggctttgaacaatctgcattttgggggttagggatgctcactctctgatacgttccatgaacttttatgtgaggtgaagtagatgggctggaatttcaagctgcaatgggagtctgtcatccatgccatatttcaaatactgtttcagcttggcttgatgacgactttgcagaatggtgttgtctaaaagaactctcggtctgatgagggtgtcccatgtcttcactgtccaaggagcagtgactggccatggcaacggggcacaggaaatgtgtctggtatgactgatggtttttagtcttaattaattaaaattcagttctagaaatcagataattctagttcctacatagcatagaattagagtcattgacttaagggatatgatttctttttccaaaataaataaataaataaacaggatttacagtttcatcaagaaaagagaactttgaagtagagaggggaaactggattttgtgtaaaaaaaaaagaaacccagtgatctgaaacaatgccaaagttaaggatgaggcctaaattcagggtagcctccagggacagtttgagggcctgctgcgtggagaatcttgccatcgagcccttggatccacagcctgcaggtgcccaaacgtacattaagcttaacagaaaccagaggcttggaggaggagttaacaaaacaacaatgcagcagaagtgtgctccttgttccaagtcataggcataaattgtcagatataactgtctactgcacaaaccagtgcaggcttctcagtgtgcaattcctttttctcttggtttttggaggttgattttgtttgttgttgttgttgttgttgttgttgttgttgttgttttccggcatttccacgccgtcttacagcagctgcacgcataaacaaacagcatgagaactagaaagtgagtcatggagactgaacagtctactcagtggagactgaacagtctactcagtgatggggggtagctcgagcaccctgttgaggtctcactgtatatcaggccgggtctaagctcttgatacacacgaacacatgtgggaagatgcttccgcctaggtaggcattagccgctggtttggggaggtgctgttttgaattgtggtgaagtttaaaacatcgctgcgtccacccacgtgggagccgcagctgaggatgatgtaaaagtcgatgtgttgttttagagtgggaagaaattgggcagctccccggggaaggcgtaaagccccagataggagagacggaggaaagagtcctagctcagtccagcctggtgaatcgatgagttcctattttagtctcaggagtgtgtgtgtgtgactccaaggtgttaaggtagaagcttcacctcagtcgctggcatccatatatacccaaagagtctgaaatgttatggtggaagctccacccaggtccccctccccgatctccctccaaaccctgctgcatctcagaaagccctgcagagatgggcaacaccactcccacagggtgtttaaactgctcccacagaaaccagacttgtggtttttccagtctccctttcccatctcctgtggggggaagaggggcgtggcctggaaggccattcgggagcactgcatccattaaacgtgggctttttctaattcggtctgatgtgggtggctgcatcgacggagaggcttgcttatcggggtgcagaaacttttcagaaagcaccagcatcaccgagagcccatctcagctgtgtctccagagctgcctgcccagtctcagccacctggagtcccctccctcaacttgcagccactgttgactgcttatgtgacctcagagaggggccccagaagtcctgcaagtctcatgagcttcccgcgccttgcttgctgaggaaacagcagacactgtaacagagagtcttgggctctgcaggactcagaacggcaaggctgcactggaggagggagatgagcgttaggccgtagagaggggagcaggagaagctactggccctgaccagctgggcccaggcacacacaagttattaaacagatgaatgctgacaagaagtgggggcgggtgtgctcagcaggtcagaggtcccattccttcttccctccctcctgcagcaagtgtctagctggtacttttcaaccacataccctggctaggagataaacctgtgtccatctttaaggggtttgggttttttttttttttaagatttatttcctttatatgtgtgagatttgcctgtttgtatgcatgtatgtacgtgcaccgtgtgctgccgtgctcacagaggtcagaagagggtgttggatcccctgaactggagttacagacggttgtgagccatcatgtgtgcatgtgtgtgctgtgaatagcactgaccccaagggccccctagaagaacaagtgctcttaaccatcctcccatctctccagccccaagtccacctttaaatcaagcctcaaattgtgtaaaactgcattaggcaaaggctgatattgtgtttcaagttgaagattagaacaaacttagaaaataaaatagatgtctgtttaattattgctctccctccctccctccccacccccctaccccaagcctatttgcttaccgagaacagcagaccagtgctaacctcccaagaatactacaaaaagaccgcctcctccttccccttactaggaaagctgaaaaatgtgtttctgccatttaacttatggtgtagcagctatcagactccacgttctccagctggtctggttcgttcttccttccttccttccttcctttctttctttctttctttctttctttctttcttttgttttgttttttgagacagggtctctctgtgtagctttggagccatcctggagtccaggcttggattaaaggcatgtgccatcaatggccccggcatggtctggttcttaaaacaaatggattcccccaaagcaccccaagagataaggattaaaatattcacagataaggtttcctttggggaacctgaactggaagggcaaagggcggggagagagagagagagagagagagagagagagagagagagagagtgtgtgtgtgtgtgtgtgtgtgtgtgtgtatgtgtgtgtgtgtggggtccttcctctcatcctcagagggttatgctaagcaatctttctcttgttctaccccccacccccagggaagctatgtgtctgcaaggggctattatgagagagccctgaggctggttccagacagcaagctgctgaaggagaatctagccaagctggatcgcctggagagaaggttacaagaagtcagagaaagggatcaaacatagacccaaggacaaagtcagtgggactcagcaggctggatgagaacagaaggaggcctaacacacagtgggcccgccagccaggcagtcccctcctggtggcacagtagtgctgaaagagttgtttccttgaagggacaaacagcaaagaggagcaaacagtctgaagggaagggaaatagcatgtgtgcttacaggctcctcccgtgtcactcccagtccccaggatacagaactccattcttactgtagcccagaaacacagaagcttgaagttctgtagaggagacagctattggtaaggaaggctgtatcctgtgaagtcagcccttggggaaatctactcgtagaagttagttaattctcaagaatccagagtgggtggtgaagagcattggtagaggctttgtgaaggctctggggcagagcacttgatcggcaggcttggtctaatatcccccaagagtatcactgaggacctttggagaagtacattaaattccactctgatagacgtttttttccagtgcctaaaacacgaggggaccgtctagaatcatacgtgggtatcattatctctacaggagaaagcttcctgagcagttaaaaacaaaagttcagattttgcttgattagttatgggaatatttttaagtgtttgaattgtattccagacgttgctagagttgtgtctccactctgaaacttcccagtgtgttagccaaaagattgctgccaccttgaaatatgctgcttgtgtgtggagcggtggggtgcagggtgcactctgcctggaagtgttagagagccagtccagagaggtgctctcctttattctcttaaggtcaagacatcatgagatttattatttttgaaagatatatttaagcatcaaggaacctttacattgtgttgcagaattcctccaggactgagttgaggggaagagagctctatttattgaattttgaggtttagtgggaattgtattcttaaaagacaaagtgactctctgcttggcaagttttcagactccacagagaatgctctgaaactcttgggtaaaatctaaattcataattttttaaaaatatatttatatttaaaaatgaggaaggcaaagctgaaatcataatttgacattattttagtgttatttattgtataacttataaaatatttaatatatatatatatccacatgtctgattttttttcctctgtacatagcagctgccaaaaccaatcatatgaaaactgtaaaacaggaaagctttaacaatctcccctgaattatactggttattaatttccacttatggaaagctaatggaattaggggtcagctcagtgtttgggtatcagtgaaggagctggagcacctgcttttaactgggtactaaccactgaaaacagaaaccctcaggtaatgcaggtcccgaagctgagccagctgtcacacaaccatgacaaggttgtctcacctgtacagccaggccagagggagagccctctgcttcttgcaacccagcattgggatgcagtgcctctctgtgttatttttttttctggcaggtaagttgaaataaatggctgaaaacttatttgaaaaggcatggtgaagccagggagtggtggtgcatacctttaatcccagcactcgggaggcagaggcaggcggatctcagtgagttcaaggccagcctgatctccagagtgactgccaggacagccagggctacacagagaaaccctgtcttgacccctgcccccctccccaaagggggtttgactcagtgcacacctacgctttggagctagtatctgtcactatcacctgattatgtaattgtctgtcagtgttacatatcataaattgatccggaatctcaatttcttccatctaagacataacatctttagtaccaaggtcaaaagtatgtactacagcgtttattataaagcagttccaagccccctaatttggaaagcagggggtacttggcaacatcttagtactactttttagaatagcgtttgaccaaaatgggtgcatggaaaaccaatgggacagattgaactgcagagtttgacataactttcccttgtgtaaagtgctacagaaggtctcagtgtaaacttgttagaataattaaaaaggcaattacaacataaacatttctgaggagaaaaagccacacattgtctaggagattgccgccatcaggcctctctcctttctcctttgtctgcccattttggcacctccctgagcagtaaaaacaagcactgcttaaaaagaaaaaacgaaatctgcttgctttgttggctcggatattaaataagccaatgagatagttttcatagtagaaatgttgcctgggagaagaaaatcagttgtgaagtgtttctcaaagctgttgagtgtgtcttgtaacatgctatttggccctggtgatgtggaataatacctgggagtcattacagtagaaagagagagcctggcttgtcttgaaaatgcatctgatttgccattggcaggcgtgtgctccatgagtgactggagagctgtttctgaaacctaggagtggagttggctttgtgcactcaagtactctgctggcaacactagcattgtccttgtcttcatcactggtactgagaattgaacccaggaccttgtacataccaggaagcactccccactgagctcgtgtttttgcttttttttaaaacaagggtccagccctgtgtctcagaattctgtaaccctgggttacagaattctgtaacataaccctgggtatgttacaggaggccacaaagagtgaatcaggagttgatttgccttggttgatcctccagtatagtggctcctggaggtctttcctcccttacacattgagccattcacatctgtgtaacccctcccccaccgttccatgtcaggcctgtcaatcatcccacctagacccagtccttgtcatgaaatccatccagtggcaggatattcacttgccctttgacacagaaactataggaatggctttgttggcttatttttaatttagggattattcagtcaggatttttcaaagtgattcaaatgtttcaggttattaacccttttataaaatctgttttggtggtgtaactcaggtgaatgaaccaaaaatgcagaaaccatagggaaataagtactttgggggtgctgggtgccttgtttggggtgctgggtgtttgtttgtgtggttctggggctagaactccatgcacaccaggcaagctgtctgtcactggctaccagtgtcatctcagccctggacttgtttatttggaaggttatgacaaagcaaagaggtttctggtctttatcagtatgcaggttctcctctgaagtctgcagcagagttttccacaggcctttttcagttttcaggcaagactaaataaaaaattccacaccacaccgcagaagcccacctgaggtgactgaaccaagggagaaaagaaagcaagtgtcccatttcttgttagcaaatggtctacatccttgtgattacagagcagcatggacttgtaggaggcctcccctcctgcacagggcctctcagcactgtctgccttgagagaacagctaggattcttccaaactccctaagacccagctctctgttgccagcaaggtcctacagagctgactactctaacgaggtttatgatttctaccaaggagctgtgaataatatcgtgaaatttttatttctagctactgggctaaaatgagccaaagaattctaaaggatgagtcattgctctgtgggttggtcaaggctattattcctagactgactggcaggtagctgagtagggtgtctttatgctgtggcaactgaactataatttgtccttctatttagaaaattcttgggtgtcaaatggagaggcaccaccattgccagttgcacacactaggttgtgtgaggttgccaaagagaaaaaaatgaacaaaaaacctgatgtctttttttactcttagaaaatgtccatggcacagagattgtctcttcctgcctggcacacagacactagggctttgttatttagttcctgattgtactcactaaaacctgtttttggtgtcctgagtgtggtggcacacatccttagtcctagcacttgggaagcagaggcaggcagatctctgagttcaaggccagcctggtctacagatcaagtttcaggacagccagggcaatatagagagaccttgtctcgaaaaaccaaaccaaacaaacaaacaaaaccacctttaaaaaaagagtcataggcaaaaatgtctgctcttgtctgtggtggatccatccaggggaatgataaaccttcatgagattggtaatgacaccgaaagcatgaggctatggtagaagtaggctgtttcgttttcttgttttcaaaaatcacactttaactgtacataggcatcaccctaatgcagcaaaacccaagtctctaaatgccaccattttacattgagcagcaaaacccaagtctctaaatgccaccgttttacattgaaaaagtgtaatgtcgttcaaacattcctttcagactgtagctgtataagctaagactttagagtaccaagaaccaatatttggaaacattataattcttgccattattctcagtttccaatgaaaacatgttatatagttatgaaaacacttctaatgtttttgattctgtgagttctttgttccaagagaggagataaagtaatctgagtacaaaatgtgggttcgtattagagaggaacaacaagatggataaaatacctggtgcagtcaattggttcatattaaaatagtccattttcaccaccagggctctttgggttaaagccattggcaacaactttaaaaacaacaaaacaaataaacagcacctcacaatacactgtcctggtccaagtgtaaatacaggtcaccaggaaatgcctgcaagcagaggtccaggatatctcctccttgtcaggggcatatggtatgtattagtagtgagcctggaagttctggctgtgcataccttttgggggttatttagcggctagcccatggtggaggcccactagttcaggattcttcattctggggtcattcactctaaggagtcaccttaccagggcaggttattccatgtcacagtaaagtttgtcacccatgaagcactcactgtcctgtccagtggttcccgggataccacgagcctctgaaatgcactaaaaagcactatgtatctgtggagataatgatttaagtcctgactgttcttgtaacaaccacaacaagggaagactaggctgcccaagtgtgttacttcacaatagtaactcttactttacagttgtgcttaaaagctcttatggtgaccctgtcactttcctgggggagtagataacatcttctccttgggaactgaggtgcttgtagaagacagtgcttgttttgacatgtggaagtcactgtgtttgtggtcaggaccttggtctttcttcctgctactcaatgttcctgttttggttggttgtatataaatgtacatccgtgttatttttgctgtgctgcttaaaatatttctccgtttaagtctgactgtatactttgcctaagtctttcaaaaataaaatttatgtaaatgtctattttatataaaacatgctaaaaataagaattctgtctggcctcagtctctcaagttctgtggctagaatccaccagtagcctttttgctggtggatctgagcttcaaaagcaaaggtggcctctctctgtcatctttcaggacacacagtgactgcttcccacccacaccaaactctacctccaggccaaactacctgctgctagcttggtaggtgcagatgggagttagaaagcaagggctctctggcaacatcctgtactccatccacaggcgtacctggacccaaccctatcttacccgcaactttgtcctctccattaacgtcttttactggtactgtcttaaagctgcctaatgggtggggacacattcattcgatcactagcacaaaaaggggagaaaacaccgaaatctccaccaaaacccaggaaaagtcctctctttagtcctccattttgtcaataactgctaggttcttttccaccacaatcatgctttttccctagtgacctgccatgtttgctcaggactgtttgtcacaccacaggaaaaaaatgcctctcctgtcccccagcaaccattacctgcctttatatcctcagggagagagggcatcacagacactgcttgggtcttgtgctgatcaccaaactgctgagagtacaagaaagagtacagccacactttctgaataggaaattgctactgaccaactctagggaagatgtgtccaaaccaaaggcaagatattccgtgtgccacaagttcactcagggcagcccagacccctccctgcgactaatgttcttttcttttacttatccccatgttgtgttattttaaatatcatcgcactgtttctctactactgtagacagtttctacttgccattcattatctttgtcataatccaggcaaacctgaccccgtctctcacgcacctgagcatggcatggcaggtgtctgtaacctggccctttaaaagaaaaaccccacccacttcctcccctcccccctgttccttacagccccccctctctcctttcttttctctcaccccttttcccttccctctctaatgaaacttcccactctgcctggcatttttgtccctcacccgccatggaacccaccaaggtcccccatgtattttgttcctaacggtcttattagtgggcctgaagttatctagccacctgccagtctgcatcataattcataccgatgggctcttttcccatggatggaaaggctttgttagggtgaacctttgtggatgaattctctacattaggatagggtctcccattagacagagggctttcaactctggtaacaacaatcatgaccagaactggatcatggcgcccctgcagttactaagcaacacagctgcccagctgcggatgatagctttactccaaaggcttttgggtgggttttatattacctcttactgaaaaagaatgtttagactgtgttcgactctgagtgtcattggaaaacaatgttcacctggggtaaatgagagctcggtggagtgggtgggtgggtggggtgtgcaatcctcatggcactggggaaagaaagcagaactctgggaggaataagttagccagccactagccagccagctcacagtgggatgcttccaggaggggacacaagcctggaaggtgaatattgtaccacctctgccccaagcccactgcctcatttctgtggacttggatcatgacaatcaagtaacactctttgggtgcctgcacctgaacttgccattttgagtctactgcttccatgtgtctgccctcccaacttcaagagacagtgaagccctgggcggaggggcccaggattgttgatatatgcaatgtcctttcaggcttgccctttgagtctgatcaaatataactcaactaatagtctggcttttattcctttcccatcctcagcgtaacttattaccatacagtattgatggagaaaatactgacatgataccctactaatgaattattatactcaccttaaacaacagatcacacagcattggctcaggctgttgaagtggatggtagacactacaacccaggaaagtagtgagtgtgaacattcttgaggagcaagagcttggacaggcttcttagaggcccaacagcagttaagccttgaatctcctgttttgagaagtgctcacttgcatctagcgtggattcccgggttcagtgccaccgtctctgcatcctactgtagtctgcagatttcaggggtctaatatttcaatcccaataaccacctccgttcctcagatctgttgcaaatcccatgggggatttggggcttactgctacggagcctcctccttagagcctggtggtcctggcatctttggtgcagactcagctctctaaccttgacacacaggaggggaccttcagccatggggacacctctcccggggccaggttggggcaggaggcactaggaaacccagaatgaccaggttgacagtgaagagaatgatcatgagagacacctgaacccggaggtgtgacaggtgcagccccgtgttgccctgagaggaattaaacagtcatttgagctcacttcctcacttggtatcagcagtctgtgggtcaggagggtgcagagctctcatggagcctctgtcgtggaatggactgctgctggcgacctgtaacccccagaacctagtaggtgagtgaaggcccctggatctgccaccaggtgaggctcactctccatggcttgctcgctctggatttcctatggttgcagtcactatgggcccataaattcccaaaggaaggcctgtcttggtggaatgctctcatctggggatttggggctttctactacggagcctcctccttagagagcctggtggtcctggcatctttggtgcagactcagctctctaaccaaatctagtgccagaggtagggctgtttctctcctgtcctgggccttgtcttgttagggcagcgtggggccagtggcagggctctgagcaacctgagctgcctgtggggtgttcctgcaagaatcccaaggaagttaaggagggggggggctgtgaaagctgagtgacttcagagtgtctgtgccaggcctgggaatctgactgaaatcttgacaaagtggatctgtaagcacaggctctgtgtgccgagtatagccacctgtgtgtgcttctgcggcgctgaggtgagaagcacacacatgcatgcaagtacccagaggtgccagaagagggcatcagagctcctccaactggagttaggcacttgagagctgccatgagggtgctggaaactgaaccctgatcctctggaagtgcagccaatgctcttgactcctgaaccgtctctccagcttcccaaaaagtacttaagacattttccaggaccctgtcttcatgatgtgttaaccttgagtaaccaatttatcttttgcttcctttctaattgctcacccagtgaagactgccagctgtctccccatagatctcatccccgctcccatggctgcctcacacttcaaaaatgctgttcataatgttcctgctgctgtctttttttggggggggggatgttgttgttgttttgaaacaaggtctctctgggtagcctctggctgtcctggaactcactctgtagaccaggctggcctcgaactcagagatccacctgcctctgcctcccaggtactgggaccaaaggtgtgctccaccacacccaggtcctgctacagtcattttattttggcttgtcagacaaagtcaagacaggtgaccttgctacataaagggaaagagaggggctggagagatggctcagctgttaaaggctaggctcataaccaaaaatataagggtaagagagtgagcaggagactgaaaccctcctgtgtttaacactgtaatgctttataaagttaaaccaagagccaacatgcagagggtaagtgtcacgcacagtctcacacagtcatttctggaggctgacacacagtagctgaagtaaatcctactgagtggtgtgctgtggatgtgctgagcgaacagatctgcgctctgtggcacagatatatctgatgggaacagcaaaagtcctaaggccagcacagcttcttgacaaagatcctgcaaagctgagccacgtgatggctgccatgccacctttggttttctctccacctgctgcatacttggggtgggggcttttagtatttgcataatttggggatattggattcatggagaattatgaaccatttatgccttctcccaggagtactgcttctaagctccccaggacagtcctgaatgtaccacccctcccccttttagggagatatccttatctacttgtaggtcttccttatgccttggaatttgtgagacgcataaagaaaccagaagtctctttgagactacgaaatagtcttgaaacatctgtctctgtacttacttgggaacaagatactcaaaacaaaggtcaacaagatttggtgggctagaggagttggccacagttcagattgcaagcctcttcccagtatacattcaggcaattacatggcatatacagcaacaaagttagattagatgaagttgcctcagccccacaaagacttatattgatgagcaaagtggagagtgaagacatgatagaagaataagatgtcaggacctccctttcttagaaaagttagcaatgcagagccacagtggtgtcatctgaccagggaacaaaagaatgccaggattggatttataaacaaattttataaagatacaaaaatataaacattgtattatgtcagaaattgaataataactgcagcagctttggcctgaggatttttcttggcgctctgaccattaagagttaataacacactacttgggacatggccgtctgcctgggctgacttgagattttgttttggtctagcatctttgaagacacaaaagcctgagaacaggctgtcaaatgcttgtagattcttaaaaacagggttatgagttaatgagtaaaaatggttataaaaggtatctgtttatcaatgatgtcaaaacttgaggggaaatgggtataaaagataattgtttatcaacaatgactaaatgagatccaagaggaagtaaaccacatgtccaaaagcaaaaatgatatgatctatgtcttgggacaacatgaatctatctctgcttactgaattctgtataaataaattagcactctgtctgttagtcagtcaggctgcaaggttctcaggaccatcatgcctggctcactctttcctttgcagactcctctctgggacttgtcaagcccttgggttgtcccctgaaaactttggccaccagcaatagtaactgtgtggaggacagttaatcattttcacatgaacacatgtgtccaaacacactatatgcttcaaatatgaacagttttaatcacctccgagctcacagatgactttattttcctaaataaagaactttacaaaacattattttataaaataattgggtttcccttttgggtaaacatttacaaagaaactgaaaagggccacaactgcttgttaactgaaaatgggtgaatttcttttctaaaaagtcctttatgtcatccattcacacttacaatctcagttcgctaaaattggcttgaaattgtgttagccctttaagtcacatgtccactcgtctggtgaggtcagttgggaatgtttcggttctctctgcagcatcagaaggctgcatcacaagaagcagagcctcccttcgtggatggtgggccatgtagtaccgttgatgcttctgccaccagatgtaaccgaccacgttgtgtgtcgcctccctcatgggaccagaaagctgctaggtacctagcgtacggctaagtacccagcatataacagcctggcagcgagcttgcgctctgcctttccttccctctggctggtgctttggggaactactgcttccccagttccttcccctccttccattccgtgtggcttccatggagaacgttagcttgctctgagagagaatgttaattatgaatagtgttctgcctgcatgtacccctgaacgccaggaaatggcatcagatctcactacagatggttgtgagccaccatgtggtcgctgggaattgaactcccacctctgtaagagcaaccagtgctcaagatcagaagaaagtgtcatgtctcctggaactggagctatacagatggttgtgagtcaccacgaggatgctgggacctgaacatctctctctattaagcaagtgttttaccacacattgatttatactgttttttgcacatgccattgtaccatactttttagttgtgggaaatgtcttcacgtctcctttttaaacttttcatcatttgcttcagtcagggaatgaagtctttgaatcagggagttagtcttggaaagctaacccttgaggcaggtggatcttttattatatcacattctgtctttgtgggaactctggtgctcattattattccactctgcttcagtgttatcaaccttgtaggtttccagggctgcacttcacatgtgaaaggggacggttgccatgggagataagacagattgggaagccgtcagagtccctttccactgagggtcaccatgccagactagctgacattgtcgggggcgggggggggggggggccccaaaaacagaagacccacctcctgcaaggctctgaactctcgccatgctctgaactctcgccatgaccaacacagaccttgactctggggtactcccgattcagcttccaagcagctgggattacaggtttgatggggatgtccttctctgtatatgtttctcttattggttgatgaataaaacactgtggccagtagagaggtagggagatagatgggactaggagacaaagagaattctgggaaaggtaggcggagagaagttgccatgtgagccgccaaaggtggtaagataacaccacatggaaatacttagaattacagaaatgggttaataattaagacagagccaataagaagcccaagctaccggccaacagttttataactaatatagtgtctgtgtgtctttgggggtgaaacatctgggagaagctccgcaacacaggtttataccttcaagcctatttgggtatcactttacataaagaagaattgagccaggcatggtagaacacatctataatcccagtagcactcgggaacctgaggcagaacaattgcaagttcaaggtcaacctgacctacctacagatcaagaagaacctgtcttcatttttttttaagaaaaagaataacttaagaactaagtttctttactaccaaacagtaatttaaagggtgactttgaaaaataaaattgaatcttcctattagagtgcaaacagataacggccgtgataatggcctctgttatgaagacattaacatctgcgaggcggtcagtaactggtgctgcagctctaaataaagggcatctcgaaacccttgactgagttggtgtcatcatgcgagaaatggaaatgagggtagttacggccagaaccaagatccccgcctgtgtgcaggaacctgctttgaataaagcagaaaaataacttcagtgactttctgaagtaacagtcctgaagtatgtgaggcttagtctacaaacagaagtgctagcgtatgcttggctgctgatggattcggtccctaggtacttcatttggaggctttggtgtggcaaattcatagatatcgattctttccctttttcaaagatttattttgttattttgtgtatatgagtattctgcctccatgtatgtttgaaaaaaaaaaaacatgtttacttgatatctcagaaggtcagaagaaggcatcagatctcctggaactggagttggagttgtgagctgccatgtgggtgcctggaattgaaaccagatccttttgagtgcagcaagtgctcttaaccgctgtgacattctccagattcaagtttttgacatcactttaatgctacaagaagcattaaaacccttaagtttataggtggagtaattttcacaaagtggataaccatgtaactgacagctggatcaagaatggaagtgccctaacaagaatagcctctgcctgcccctgctacttgtcactcccctagaagtagccaagtgccctggatcctaataccatgggtgagttttgcctggaactaaagactctttaacctgtttctggattcttaggagtttttaaaatgtggcctcttgagatgcagccctgtcagataccgtcttgagactgggtagtaacaaacctagaccacaagctgtctcatcttcaatgcgtttttttccttacatgttcttaatattcttgtcaaataagccttatattttcccttctctatctgaaaacagcccagtgatataaataaggactccaaagacattttacagctgaaaggaatggatacaacagtccaggagtgaggattgttagcccttgagaaaaaggcacagagtgtgacatgaagatacggtccccatgcctctctctcacacaacatggagcatccctgggtaacttcctgggcatctggaggttcccaaagtttgtatcccctgagaaaggaccatggaaagacatcagctggtatttctcccagatgtcggagttggtgaaaacatggtcatgggacgaaatgctttcttccatggtccacatctcaaggtcaccctgatatgccctgctagaatcagaactaacctttagaataaagaaaacttgattgatttaaaattcttagcccaacatatatgaatgtatctcagaacttgtgagcattgatgttttccattttaacacagactggatcttgtataaaaatttcataaggtttgtttttctgtgtttatgagggtttaaagcagcttttgaaatgagagtcttcttttttttagttgtcacctcccctaacttcttacatttggtcttgttcctttctcttggcattgtgtggaaattagggcggctctcgaaagttcatcttgttaagtggctgtagaatctagatccagaatatgtgtggatgtcgtaactcagttctgcagctctccagctctggctccaggagcccaggcctgcatccctcagacagtggctgcagtaactcaggcctgcagctttcagacactggctgcagtagcccaggcctgcagctctcaagacagtggctgcagtaatccgtgtctgcagctctcagacagtggctgcagtaacccgtgtctgcagctctcagacagtggctgcagtaacccatgtctgcatccctcagacagtggctgcagtagcccaggcctgcatccctcagacagtggctgcagtaacccatgtctgcatccctcagacagtggctgcagtaacccatgtctgcatccctcagacagtggctgcagtaacccatgtctgcatccctcagacagtggctgcagtagcccaggcctgcatccctcagacagtggctgcagtaaccgtgtctgcagctctcagacagtggctgcagtaacccgtgtctgcagctctcagacactggctgcagtaacccgtgtctgcagctctcagacactggctgcagtagctaccggcctgcatgctcttggatagaggctgctttcctgctaactgcacattgtcctcgggcttcatggtatttttaataatcctccaaccaaacacagatcctgcctaacatgagaccaagaatagaagcaaaacaacagttgctgccactttgcagataactactgttcaggtgacccaaactcatctagaaaatgttcaggaaagaacattcaaggtctggggttagtaattttctttgcaaatcttaaactgtgaatttcttctggctggtagacgctagagaagcagagagtctttgtagccatctagcaatggtttccagtccacaggcatagcttttgtatgcaaaaatcttgcatctatgaataggtgcctggttgtcagagaagtgtacagaattttttaaacttctaccggagtactgagcatcggctttctgggtatcttatggattaagattctggttatgaaacaacaaagacagccatcagaattaactcggctcttaattctcctccagtagctattgtctttgctcataggattttggattttagtatcgaatggaggggttaggtgtctgtaataaactttgtaggaaaatggaagttctgtagttcatcacccttgtttcacaaatgcttgttcttttccttttcccccccccctgcctctccctaacctacacaagcactcaactctggatgatgactgggagtagtagaagaaaattgaaaaagtctgctgggtgtggtgccacatgatgtaatccctaacttgggtggtagatgcaggaggatcactgcaagttcaaggccagccagagatagagagaccctgtctcaaaacaaagaaaaccaaagagtatgcaaaacagggaaggtagacttgcaggcacaccttgagtagcgaaagggtctgggactcagcactgaaggttggtggtgttaggagcaaagagaagttcattcatggggttcgacagaggcaggtgagggtgagattccagcacttgtggaatcccactctggattgccatcttctcagaagataaagagcttgttaaagagatcttgacaattttaagagaaaacagagaaaccatgaaacatttctctatgacatagtgcccaggatcggaagacagaggacagggagatcattgagcagggtagctaaggtgaatgactgtgaatttacaaagaaacagttcccacttcacttagctgtctgctttccacgggcatacggaggctcatgcagaccaggagaaagtggatttactcacagtttttcccaagtaggtgtagtggagtggagttcagagaatatgggaagaggtcactaaagtaatatatcattgcggtgtaagatggcaaaggagtgaagtaagcatgagagatggaaggggggaaaggagggagaggatggggacagagggacacaaactataaatctgacagatgaagcccataaaacttgatttctgtgaccaaaggtaaattaattatttttattttgttttttgggtttttcttgacagtgtgtgactctctagcacaggctggccagtgagtaaatgattttgagtccctgtttaatcattcaggtcagtaagtggcagtgataactgtcagtgtatcctttgagttaccccttcaagttgctaaaagttagtgttgagaatggcaaataagacgtttctgtgctgtatatgttcacaaattctttaccatggcaaagaactttgacgtgtttatctatacaagcatgttgtttggcttagtgctacgagatattaggactgtgccatcttgacacccagccactccctctttgctgcttgtgtagaagaagtgacaaatctgggcatttgaggttgttatccccattagaatccatactgtgccatatttctggcagatttcccatggcagatccatgttgagaaagagtaaaatcattgtaccaaaacctccgacagatcatgcaagattcactgtgctggttgttttgagtggagaaggaccataactgttttactttgttatccatgtccaaactagaggacaaggtacaatactgttagaccaaaacagaccaaggaatatctacttaggtgacaataaccaaataaaaagaccccttctgaagtgacagccagaggcactggagtagaacccagaatacctgcagctcttcctctcccttgggcctactgtcactctgctgtttaggaaagtctgtttgcatgcagtcgtccccccaccccccactccccacccccaccggccggctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgagctgaacatgctcatgaacgagctaaccctgcattcgaagaggaggagcccttcctgtgagggtatggatgcgtctgcatgcaaaacagtaaaggaggcttatcctatagttaaaaggggtgaagtgctccatcagaaaactctcaattctgataaatgcttttagaaaagtagcagttacaaagtcaatacacggaatcagtggctttctgcctacatactacttacaaacatgccaagaggagatcagaacaatcctattcacaacagcattagaaaaaaaaaaccaacaataacacaaaacctcagaataaacaaacaaggaaaatattttaacaagaaaacagcctgagatgttgattatactagtctggtatttgttttgttgttgttgttgttattgttttttgtggtaatctagaaatgtcttaaaataagtttggtaaatgtaagaagggccagtgtttatcagtatattcttcatgagattgagataaaacagttgggttacatattttaatgtaatgtgaaacatgagcctacatattcttggttactcaactcctatctataaagaacagtgaattggggtctagtcatgtgtttataccgattcttggcatatgatcaagcagttcaagattggtcttcattaacaagcaagatcactaagtggtaacattctaaataatacttttaattctgtatacaaagaacagagattgtttccaaatgctgattcaagtggatgataaggaaagaatcaataagcagaaagaaagccacgaagaaggttgtaagtaccatactttggatgaggaaggaccacgtgctaaagggaccacgtgctaaagggagacttttgtctggaagtagaatgaccaaaagacagggcaacactgaatgttcatcaaggtgaaggtacttctgagagctgccttcatgcccctcatgcttctagtatccagagcttctgagtgtgggtctagaatctcaccttcctcaaccatggaaatggctttgaagtggttcaagagcagggatgtggctgctctggaaaatgaaaaaaatgaggtgcccccttgggtgtcaccctttagcacattccaggtaactgtgatgaggaaagaaaaagagactatcataggtgagtgccccaaggccctagcatgaggtcccccagtcatcagcagcaacactggaaaaggaattctccaagtccccaggatggggagggagcaggtatatatgacttctaacagtttcttctgtagaaaatgaagattgacagccaaaggtctgtctggttcactttaacacagtcctgatttttttccaagaagtcctttttgatatatctaaagagaaagatgggatttttactcaatactggagccacatactctgtgttcactgttaaaaaggtatcctatgcaggtgtgtgtgtgggagacttatggttcctccagccactgatgcaggctgagaggtttcagaacactcacttctggtgttctgaatgccctagtccactagcaggaagaaacctattagagaaaccatgagcgactgtaactttccagtgggatagtgaggaaactttgctaaccgtcgtcatttcattcctgggacaaaatacctgagatgaacaggaaagaaggaaaaagaattgattttgactctcggttttagaggtctcagttcagggtcatattgggcgtgtggtggatccttgcatgagggcaaagtggcaggaccaacctctcatttcttctgtaaggttgcacctcctaaatggtcccaccatctcctgtgtgcccaagcatgcgtgcatgtgtgtggtgtgtgtgtggtgtgtgtgtgtgtgtgtgtgtgtgtgtgtgtgtgtgctgtgattaggagggagtgtcccagggcgaggcttatctgttgcacttgaacgtgctggtccctgagatatccccaaatgtaggaaacacgactgtatggtttgtgatagtggaaggtgggggctgcactagagttctccccttaaaaaataaaaataaatcttaaaagaaaaaaaagacattccctccaggttaacattttttatatggcttcttaatcagttgatagttaatggacttcccatacaattatctacttactattttctctctgctcacacaggcatcacgagacattaagtgtttcactcaagtcggaattcattaacgttatcttgtttcccctagccacctcataattaaatcttctaaaaatgaaattaggttaatttaatgtggcatgttaaggatcttgtgctggctgctcacgaccactgagttcttctggtaccagaaaaccatctgcctaaactttgctcttacattttgcttaagtttacttttatctaacacctacttatgatccattgtaaacatcagttggtttaatccactttgagtattatattacattataatctcaaaaacattatgtaaaattatgtaaaggaaatccaaggcagaggaggttcaggaatgtgcccaaggccacagattttgaaaagtggcagagattatgaatcatggttggctcagcagagtggctgagtcaacccacagactgctttgcactgtaggggaagggtgctctgcccataggaacagggacagtggggacctggccctctgagaccagcctacagcacactgatgaaagttaaggtaagacctgaggttctgacaccactggggaaccatggaagagctgtcaaggtgttgacacagctggctgttttttgactgttcccctagatacacacaaaatggcaaaaactgacaaatggaattatacaaaactggctggagggttctcatcccgctcgccagttccccattaaccaattaattatcattgtttggccattggttcaggcatattactaactagctctcacaactaaattaaccccttcctaatatcctgtattttaccatgaggctcgtgtcttgttacctcacatcttgcttccctggcggctacatggagtctccctgactttgccttctttctctctgtatctttgtttggatttcctgcctggctttattctgcttggccattggccaaatcagctttattcatcaaccagtaaaagcaacacatattcgcaccatacagaaggatcccccatattacaaaactaatgttaaaaaaaccttatgtacaacaaagaaaataatcaacagagcaaaaagatggcataatgaaagagaatgtctgttgatattacctgatgaaaagttaatctgtagaatacataattccaaataaactgtaaaaataaaaaaaaatccaagtgaaacaatgaaaatggatcaatggccaggtgtggtggtacaaacccacactatcactttgaaaacagaatcagaaagattgtcatgactttgagggcagcctgtactacacagcaagttccaatcctaccaggtacccgtttcagactaaatataacactttaccatatttatttctggtatcaagtctagacttggtttgtaaattctgcactgttttaaagattcacccaaagagcttatgggattttgtgtttcctgttgtggagtattttgtatttgttctctgtggttctgtaatgggtatttacaatcacagattcctcagtctagtggttcatgattaaatcattttctcttatcatgtttgcatcttagaattacataagggctttaaatatgccccagatatttacacctaatcacagccatctcagaaacaatgctttagtatatgcccagaaaaatagttgagtctaagtactctgatgtcttcagttctctgaggctgacttacccacagcagggaaccctaatcacagcttctcagcagcaatgtgcacagctcctttttctctatattctttgctttcaatcttttgctaatttagagactataaaatggtagtttgcatctgtattctattttgttggctagcttttcttctcttcagccaaaccactctatcaattcattttatattttcttgtttaaatccttctactttatctttgcctttttaatgtttagaatatttcattcgaatatgttattacacacatacacacacacacacacacacacacacacacaccacggctttctgtgtagcacttctttcttcctggggatggggtaggatcccttctgaaatgggcatcttatgagttactaacaggaaaggttggtggaagaattacactgtagttggctcccatcagaaaggtggcagaccatcagtttctgtgacttaccttggagaatatatatatatatatatatatatctaaaatttgattacacagctacaattttgctaaaaccattatgccctgcttacaatgggtttgttttagaggtatgaaattttaattcaaattttgaaacagttatggagcttttattagcagattttttttttctggacgagaagaatctacctactatagctctgatatttccaggcaataaaattttcacaatagaactgttatgtctaggaagcaaactgtcttttgttacttcgttaaattggtttggatatattaagcagcgctgttcaagaattcaggacatctgattgctcagttctcatgtctccaattcttttattcttctcaaagttcccacaaaggattagtggcagagaaggagggtggctgatacagtgttggacagcagttctcttaccaaactaaggacatcaggtcagcgtgcacagtaactgtgcttagtgacacagatgagcaggcagctggataaggtgggaagaagttgccatgttgcccctctccaggccccacacagcctcccacagagatacctttcacttaagggagcaagacagacttgggttcagatttctaacagtgagaccagagatacggagagctctgtggtccctgcgtctaggccactccagcagactgagttggttaactacttttggaagatgcttttggttcccccacttcctgaaacctctgccggcaaagcagggctcaaacctctagcagtggcacacggaacacagaaactggtgcagggatttaccctggagcccatgccacagggagcctgggcccctgggaggaacaggagacccggtgtgcaggtcagagctcccagatggagcctgtagcctggctctgacgtcaggcagaggcctgtgtgctggttcagctttggggtagagcggacacacacttctcttctggaacaggaccagtcctgggactgtaagaccctggtgcctcccctccgggtggtttccctcaaagccagtctcctaactcaggtagcacagttatcaacagtgcttatgcttcaggctttcaaacttctctgtcgtcagaccttgtcccagtgagacagacttgttttggccacagccagctgtggtgcgaccccagtgcgtccctaagattaagcaggtacttatggcagtgagactcaggaatgacccagcttaaccctagcataggtggctaagggggtcttcagtgctgctgtccccaccttggatagaacagtatcatgtgaggcccgtttgttggtgttggggcaaggttgcaagcatgagactttgccttgtaacttagtgctgtgttgataaatgggaagaccctggagacacccccaacccccagatctgtctaccaataaggcctctggaacagcagcagactcagggagggcagcccccccacccagtctgttggactaccaggccagctacttcagcctgtgtctatttaccatggccacggcccacaaatcctccttagcagagtctgctactacagcagtatagtaacttggtcctaactcaaccattgtactgctcctgtcaggctgtgggctcagtggatcacacagctgggtggaataggtggttacatatgtgacacaggagtcagaggtgggtctacccatggtgagcctgcccagaggagggcagagttcagcagcctatccgcaggccagtgactgtggaagaggcatctaaccctaacccggtaccagggagaatcctgcatcatccctaggaggcaggctatttctagatctccaatttctttttcattaacactccaagactgattggaacaaacgtgggcttagatttccatctaaaacttccaaaacgagacccccaaagcacagccccagcaaatctgcagcaagctcaaaggaaaccagcctcactggggacagtcaggctcagtggaaatcagactagagtaaacaccttacccttgggtgctcacatgtcacactagcttgcaccaagggctttcaggggactttagggaactctgagctcatgtaggactcaggcagtaacctgcacaggggtcttagtgagaagttgaaattaccattttaggaagatttgatgagcttaagggaacagaaactcctaacagaggaactcatcaagctgaaagcaaattaaaaagttcccaaggtaaaaaatattctctgtgaaattgagactctcacagaaggcatcaaaagtaggtgaattgaatagcatcagtgagcttcaagatgagcttcttaaaatgcactgttggagataaaagaaatgagaaagggaaaaaagcttatgggaaaattacgaactactgaaggaacaagtatgctattggggtgcaagaaggacccgtgaatgccaaagaagaagaaagcctattcccagaaatagtaacgggaaagttcacaaaccaggagaacagaaaaatcctggtatacgaaaggcaagagtcaccagtcaagcttaaatcaacaaagtctacctcacaatggtataatcaagcaaactctcacagctgaaagaagagccccaaggctataagaaacaagaaagaacacaggggagacaaaattctcctaacagtgcacttctcagcagagacatatgggctgggagtgttgtgaggttttcatggtaatggagagaaagagaatacctgtcagcggtccccaaccaagctattctgtaaaaaacgaacagataatgacattcccagattaaagctgagtgtctgtctagacctgctgtagaagtaatgctaaaggaagttctaagaaagcacaggacagctatactcctagcacccaggagatggaagcagcatcagtgtcaggagttcaaggttacacagagcaagttcaacgccagcatggcctacaagaaatcatgtcaaagaggacagagaatcggggagataaaggagggagaggaagaggaagaaaaggagaaaaaacactagtttgtaaaatagggtgagagtgaactatgaaacacactcaggacactatagtattgtaagcatggagcagacaacattcaaatttttagtataaacaacaacagaaaaccaaaaccccaaacaaacagatgatgggacctagctggacaatgtactcatataaattcagattttcaagctccaaagtaatggagcacatggaaaaaggatgaagtgcataatctacaatgtttgaaaatgtataggcagctaagtatggtggctcacatctgtaacgccagcacttgggaggctgagacagaacaacttccccaagttcagggtcagcccaggatataggtcaagtctgtcttagcaagcaaaagctagctggtacaaaatttgagtagaaaatttgcaatcatctatacttgaagcacataatgaggacgactctggtggatagcctagaagctgggcaggatttcatgaacaaattgactgcgggcattggcaactagggagagaaaggaaacacagactaattcaatcaaatttgaggctggtggtgattatttttctatatcgagagaaggaatagatttggggtaggaataaaacataaaatccacttgagatatatgggggcctttgtatagtaaaaaaaaaaatcagtttcccttacttttgttatttacttgctaaagttcatacccaaaccacagaagtaaaaagatgccgtgaaaatatacatttccacgggatacgggttcttttgaaccagctgttcatcccacactaaaactagtgtccaataagtgaaacataatgggatgaattttctcaaaagcagatttttttttttccagatacagcaccatcagttgtatggaaattaacctataaaatcaggcagtgtacctcagtgcagcttaacttgtatcaggccccaagtttcatcccaagtaccaaacacaacaaaacaagcaagaaaactgattgattaacaagtttcactctttggggaaaattaactttaatgtccatgtgagctttgagaattgtggctttctaaaaatagtaggatcaaattagttagttttgctatattgtgaaagctaactctcaggggacagttattacccgaaaagaaacttactctggagacgaaggatcaggtgtgtaactatgtgaacaacagcccagcctctgtccaagtaagagtctgtacaagacctggggttagggaaaagggtcaagggatatgtctacccatgtctttatggctaagattatagctaagatagaggtgcacagcagacatgtattgactcaaggcggtgttaggaccatttcacagcggagggaaaggaggtacaaagaaacgaaatacgctccaagtcacacgctgtcacaagacgtcagacgggatttttcaggctgggaaaccctggctttcagagactgtgcttacacccgttcaactctgctccttcaacaagtcagccggggacctttcaattaactggagtgatcttcaaagtctggaaaaatttaaagttgccgccagagggcatggatctgcccttggttccgggggcgtaggagatttcctttcccagttaaaggcgctcacagagtaaagacactggtgatgtgagcggttggagatacaggcgctcacagagtaaagacactggtgatgtgagcggttggagatacaggcgctcacagagtaaagacactggtgatgtgagcggttggtgtgtacattttgtactgcggtcgaggtttccccgcctgcttcgcttttggcagctcttaactgctccttaccccgctcttgaaactaaaaccccttacctactgagcaagagaaccacgggtcattattattattattattttgcaacagccgtgtgaggatccagcgcgaaaggacgagcgtttggggcggcgcgccccgggcacacgcgcgtcgtcacagacaggccgtggcggacgggtgggcgagcgtcgcgatgggagctggcgtgggcagggacaggaggagacgaagcgtctcgtttcccgtacggcccaccatttagggaaaaccgcccaccacacggcaccggctgcttaacccccgaaccgaacccccggcccggcccggccaggggcggctgaggcgtcggcgacgaaagcgccaaccactactcggccgtgtgaacgaaccacagtgcggccggggcctggcggggaccgtggtctcctcccgccgtcggacggaaggcgaaacaaacgtctccctccttcccgggaaaacggacgagcctctcgggggcgctccccgcggccggggcagccgggccccccccctccgccgcttgatggcgtcacacaccaccgacgcgggaagcatcgcgaggtctccgggcccgcccctcccctctggaatcagctgtgagtgtgagagcgccgtgtgtgtgcgcgtgtgcgcgcgcgcgcgcgcgtgtgtgtcgcctctgttctcgcgatattcccgtggacgccgggctcgggcgccccaggggcttctgggaaacatggcggtcggctgggaccgtagcactaggtaggactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgaacggttccgctgctgctcggccaccccgtgtgcgtccgtggacgggcgtccgtctcctcccggggacctggcgtgcgtgcgtgcgtgcgtgtgggaggcgatcggtgtgcgcgcgggccggtaacagctgccccggtgtagcggggagcgatgaaaggccgtgtaatttaaaagattacaaaatgaggctttgttcacgggctggcagcagccgtggtgccgaatttgggctccttcccgcctctcccggcgtgggttcctgcagaaacgggtcggctggtttgcccaccttgtctgtcagtcgcctcaagttgttactgcggccccactcggtggaggaagaccccggccagtagaaagaagccccgtgtttgttttttgtttttttttggtttttttggagtgagggttgggaggtttctctctgatagtaaaccccaccacgtacatgaacagagtatgtatgtcggggtccaccttgcagaagccaggcaagcatggcaaggtaagaagagaggtctctctgaaaggaagtcattgcagtttactgcaagagcgacggagacttaggaaaaaaaaataagtttatcttcaccggggttagtcgtttcaatgataattcattaaaaaaaaaaagttggtttttagacttggtgtgttacaaattctacttaatagtctgtctggagtttagttctgttttaacgccaaagagcttatccttggacttcggcgccctagttgcctcaccagtaaaatgagaatgataaggtggtacttacctcatagaaggttgggaagagtacatgtttcagatcgcccaagtgtttagaacagtgcctgccatactgcgcttcgtctgactgtgtttggacttctgaagtttcgtgcggcttggctacttaggcactgaagagatcgtttaaaaattagtttctaacccctcaaattgattaaacacttgaaggctatggttagtaggaacgtttgtctttctgcttctccatgcagtcttgtttatatcagtaatgctccccacacttctctgttagctccttgtcttgcatgtgcacttcaccttttctgttttgtatctccttattttcatctaaagaacttcgtttgagtagctgctgttgtccttacttcccgttgctggaaagcacttccagactcttgttggaatgacacttgttggtggtctcttccttttaactatcagtttgtggtattatccactaactcgggtacacccaaacttcctcacatcctgattagaaatacatctatcttttctgaaaattacatttattaaatagctcactttattttgattggtaacaagggtagccctcatggaaggaattctgagaagttgatgatcttaaaatttgtaacaactagtaagttcccagaagagagtttggtttgtgtggttgcttggttggtctgttgtttgtttctcagatcacaaaacttgtacagcatattatcttcccagtgaactttttattcctaagaaatttatggaattaaatctgtttaccataaaccaggaagcttaaaacagtggaaattgactgttttcagttttcaagactcaaatgaagatgtgggaagggtctagcttcatctgaaggtttggaatggaattcgtccttgctgtcctggcttctgaacaatccctgtaaacacatcactctacactctgacacccctccctctctgtggggactcacttctccatgtggtcttgagagggcgtcagtctttgttttagttcaccctaatccactatgttttcagctaagtgtttttccatttacaagtacccaggcctaggacttcagcacctctctttgaaaacaaagttcattccacaatgcagtggtatgctaatcacttagctatttctcattgagaagtgcacattataaatagcaggagactgagtaacattgataatagaagataaattcttgttgccagtgaggtagctcatctgacacggggcctgatgcttgccaggacccacaccatagatggagaggactggtcctacagattactttctaacgtctacattgttccatgacacagttccccctttgtaatgaatgtaattacacaggaggtttcatttcaaactaaattctttgtttacatacgtaataaacttaattgatcaggctgtatagtttcttgagtcctatattttattctaatattaatatggatacaatgatgaagtaggctatacattgctgtcaggagtgttggtgtctatttcagcatgaagagttttgttgtttctttagcagttgttcaagtattgtcttagttgctatcaccatatccttgaggtttaatttttgtttctttgtttaaaggacaatttaggggagacatcaaagaaaccatatgtggtattagagatctctaaagtgtacacacattgtctaccagtgaacagaaacatcgtgcagagattcccaagtctttagactttgtgaaacgataagaaatatatacaggagtaatgctagtgaaggctgggtttgtagatgcaaatagataaaagtcacagtgttaattttactaaataaggataacctatgtgatgggaatgtcttttgtacatacgcttctctggttgatgaattaaacactgattggccaggcaggatggtaggtgacgctaggagactaagagaatgctggaaaccataggcagagggggtagtcatgtgagcccaggaagaggggactggagtcaggcgttctccagttagataagactttgtagaaatagagattagtagttacgggttaataagacagggctagccaataagaagccctcgtctttggccagcagtttcataattaatatagtgtctgtgtttatttggggcaaggcggctatgggattaggctagggggaaagagtgctcataacacctgtgttatttattgtatcttttatttttattttatgtgtatgggtgtttagcctccatgcatgcatattccacatcagatgatggtggagtggggggagacaagtattgactgatccaggtacagaagccacgggaaagttatgaatgcacttagatgtccatagatgttggctacaagccctgaagtcaggggcgctggaatttggaacagactttggagacaggctgcttgagactaaacccctgttctacatagtacacttgcatcttctggggaaataaatataagaaataaaagtggcatctgtggtatagaagaataagttaatatgttaagtgtattgaatagtatctagcatgaaagttgttctgtatgtcttaactgctattattaggggaagatagacttcaaagagaagagattcagagcatgacttttttaccctttgagtgttaggaatgaagtattgcatgagagtaacaacaccaggaagtaggatttcataaagttcaggttgatttttttattttttaaacaattggataacttgtgcatgtcccaacggtggctgtacagtggcatgtgttggaatggatttcttgggagtagttagtgagcttgcaggaatgggacagaagtagagtggtggcctgcttccttctaaaatggtaatcttagaaaacagtctcggagcaggcctgagactggtaggcaggtggacttcactgtctggctccaggaggggaaatgcataggttgtatttgttctttgtgtttgtgagaccaacagctacttgctgtagatccattgaataaaagaaactataaagcttactatgaaaatgtacttaagttttgcaagtggactccctgtttatttttccagtaaaattttttacacaactactgtttagagctggtaattctctctagtgaacaaaatcattccccatggatagtgtttttaagtgttcctttacccatacatgacagtttgggtttgcagtgctactgagggtgtttctcttccttcccttaatacttacttacctgcctgctgtgccaggcattggtgctacaaaggtgaactcagacatggttccttccttgactgtcctgaggagaaaatagaatctgcaatcagtggctagaaacagttgtaggcacacaaggcccagaagagtcagtggagtcagtcacatgaaagcttgggggaggacaaggaacttgttgtgcagagagagcacggttttcagtgttgctggaactcagactgtaagacggtgggtttggtggacttggtttgtgaaggattctgaagccattttaggatagtctaaatactatgttacgggaagtgacttgggctttgagagagataatatgcaatatgatggtcgttaataattggttaatggccggaagggaatcgagttgaagcagtccagcagcaaatcgtagccattgagactaaggtcctagtaagggacttctctgcccccaggaagaaagcaactagagaaacttaggaaggggttaagtctgaaggtgtaacttatgtttctggcttgtacagtttgctgtgtactgttaatcattaagacatgaaagtggaaggaaaccaggggtgaagtatttcagtgttggacctctgggaaagaaatgcatatagtagaagtcaaggagatattcttctgaggcatcacagctgaaaacaaagattgggaggaatccaagtctagatggaaaatgagacccgggaatcatttgggaaaatgagcatcatgtccactttcaaaatcttgggttttgaagcagtttggcttttcggcttttgattttgagatttgggtacttgctgagtttcttaggtcaaggcaagagactgtttgataaggaagacctctttttttttacacatgcgtgcatgcacacatacacacacacacacacacacacacacacacacacacacacacacgcacgcacgcacgcacgggtgaggaatgagaatttgaatataaatacattctagacaaagctacagaatgaagtttttctcttggacttagtaccacagaagagacaaccttgagccagttcggtgaggagatgggaagggatgagatgaagggttgggctgtaggtgtgctatcagaaatctgtacttaagacttggactgagtttaaagagacgtgaacattttaaatatttaataagaggcctatcaagatggctcagtcaagtgcttgctgcacaaacctgaagagtttagatccttagtgcccatgacaaaagctatgtgtggtggcatgcagctctaaccctgcagtgaggaggcagatgagggggtgtctggggcttcttggtcatccagtctatctggattgattagccccaggttcagtgggaggagacctgtctcaggaagtggagaggttgaggacagtgcttagcattgacctctgactcccgtgcacatgtgcatatgcactagcatgggcggatgcacgcatgcactccatccacacacaggcacataacgtctcagtcacacaagggactgacaggtcagtctcaggtttctgcttaggttttggaagtggtctagaggtgatttaaaagtgatgtgctgggatcattgcaagtctccatcttaggaaatggcttgagcactgtgtattttcttgctgtctgtgtaaccaagacgctgagaagcacctgtgttgtgaaacttattaatatatgagaacttagtcacagcttatgttgccttataacttttttccatatatatgtataatttgtcaacttaatacaaagtaaaattttaactttttaagtgttaaaaatgtgacagtttctcacttttgattttctatttaacgtgtgtttgtatattgcctttcattcttgattttttctgagtgggaacagattaaagagtaaaatgggcttttttttttttggtcaacaagagatgggaatgctaatttctgagaaaactggtcatatattcatttatctgtttgtcccttagcatgactatatgaagggagaggaaggtttctctgaagatgaggcgactgaatcggaaaaaaaccttaagtttggtgaaagagttagacgcctttcccaaggttcctgacagctatgtggagacatcagccagtgggggaacaggtgagcttgcttcagactgccttaggcatcatgcacgacacatgggcgctggccatgaggatgagctcatgctggatcttagagtggctttgtaactgctcatcctgtgccaaattgctctgcttttattatctttattctctgtagcctttggcagtgcctctgtgccactagcagtatttattaaatcttaatgagcaagtagtacagtttacaccgtggtgttattgtgcatataatattatacaatatgttgtatattatattataatgctgacacagctctgttcctattctgggttggatagcaagtaaagacttgctatgataaagtcctcagaatggagtgagagctagctcagtttcatctgccttagttcttctgtgaaatgaggatgttagcatttatgtggctagagttaatgtattaatgatgtaacttttctgtaagtgcttagagcaacacttggtacaaatactttactttgttaagtaaagtaagtgatagaatatgtaaaagaaatctgaacctataatgatgcttcctaatatttttcccctatggtgaattagcaagtaaccccttcatacgcttttgcaacgtcattggattaaaaaaaaaaaaaatgtgtaatacatacaacccagttgttactgctggcctagcacgtgtggagcccaggctttgaatccagcatcacgtaaactgggcagggtgacacatgcctgcaatcccaacactggggaggtggatgcaggagggtctcaacttgtagatcactcttggttacgtagccagttataggctagcctgaactacttgagactctgacgcaaaacaaaacaaagcaaaacaaaacaacccctagtgaataaagtgcaataaaatggcttgctgctcccaacccctgagagtgaagagagtgccgattcttgttgcacagcctgccgtgtatcttgtattatttagtaaattcttttgactgggattctatttaatatgctatgtagtaatatattcaggatattgcaaagtacatgaaaatattttaggggcttggagagcttttgattttctggctcacagatattgtggcatctcaggacctcttttgtttgttttaagttgcattataagcatatgtgtatttcttaataaagagggaagtgtttttaaattggtgttgtcaacatgcttatttttattagttatcctatctgtgcctgatgtgtagcaatacaaacctgtctgtctggcgatagacactgttgaaactgaagacgagtcgttctttctcagtatgtggatgtttgtgctcggttgtcatttctgaactgtttccaaacatctgtaacattttaagggaatcatttatgctgcttatttacataatgttcatgttggacacttcctttttttcctcattttaattctgcttaaggtaactgtttgcttttttattgttttaattctgtttttctctttttgattcctcagtttctttaatagcatttaccactatggctttattaacaataatggaattctcagtgtatcaagatacctggatgaagtatgaatatgaagtagacaaggatttttctaggtaactaactttttcttgtttaaaggccatgtacagtcagctgtggtggtatacatcattactcccagcagtctggaggcagaaacaaatgaatctctgtgaactccaggccagcctgagctacgcagtgagagcctgtcttagagaggaagggctgtgatgcccatagcatccgatgctttcctggtggtctgctctcctttgtcctgacccaggcctggctctaaggctggctgtctttctgttgggcatgtgtgccaggcacgtatgctcctctgagcactaatacttgaaccaggagcatccacttgataattccattccgtagtaaagaaacgacattgagggacacccaacgtaatgtgtgatgtatagtttttatgataagtggaagaaataacttggaattcctgcttcttgattcaggttttatgtccttaaaggactgttttatctgaagtttcagtaggccaaccttagtttcttgggattattggctgtaaagttactattaagaaagatgactgttaagcatggagaagcagaaatggtttttgaatagtcacttaagtgaaacttttaggaggccagagggatgggtggctcagtggttaagagttcacattgcttttgcagatggtcagagttcagctcccctacccacctcagggggttcacacaaaagagaatttttaaatgttctcgttctcattgtaaagactgcacattaagtcctaacttgcactctgctgtctgaagtccacatttttcatgggtgggttggttttcatttctggtgttttgctgattgactgatgactgatgactgtcctcttctcttttagcaagttgagaattaacattgacatcaccgtcgccatgaagtgccagtgtgagtacaccctcagcaccgcccggctgtcagctcactgcctttcctgaacatgactatagtgtaaagaaaaccatatcaaggtttctgcagtccgagttgtgatttggatagcctgtctgtcttgtagagagccaggctttgtacccccactccacaaggcattgtttcacctgatccacctttaccacacctttactctgcagtgtaaattacaggtgcagtgtttctgttaggtgaagagtgataagtctcctcttctgccccaaccctgaccgtgcttactgtactgataaaagtggaaatgtactgatcgatatctggtggattatgcttgaatcagcgatgatgctctgtatggaagtcatcctctaagtcactgcttggaaagtggaaaccagtaagacattacttcaggcaacgcttcagtaatgaagaagttttaccttgttaaagggatcggttctaggggatttcatcacaaaacaacagagtctcatttttcagtctcagttttctttatgttagtggttgtgagatatatggaaatacattataactaaatttttgagttagcactgatcctgaatctatgccatatttgaatatttaaataccattaaaattttagcttttcagagtaaaatttcctattctttactttttaaaatctcagtagataacaccttataatttctttgaatccttaaaatatttcttgtgattaatattatgttcagcatttttagtacttagagctatttaattttggcaagctagtcagtcagttaaccttagcttctttactatgtgtcatctttctcagagcaagaaggagaaaaataaaatcattttcaaatttcagaatactatccacaaaagctacgtaatgctactgttttaacttttgaacaaatgaaagttacctcaggttttttgtttttatatagcagatggtagttttgattgaagttcatagtgtaaaaactttgttttaatgcagatgttggagcagatgttctggatttagcagagaccatggttgcatctgcagatggtctatcttatgaaccagtaagtttgatttatgtgatggagaaaagttatacctaatatcaaaaacttgagattggaacacagctggcatttccgataggcctttctaatgtccgttacagttcaagtcactgctttctatcgggtcacctttctcttttgtatttgccataagaatggaagtttgtacttcgtagttgtctcaggactttgacctgtgcctaaatctttaaaaacatttaccctgtagctttcttatcattggcatttacccttcccagtgctgatttctcttaattagttctaaagtacaagctgtccataacatagctgactcaccacatagcgcattacaggactagcatgtacgattgaccaggactagctctaaaacagcttcagaaaaagcgtgtggcccactggcctcatggtatgtagtttacatacggctcactttaaaattcattttcttgtgactaagcaaacttgaagaataatgactacagagggaggaagagtagaattcattggctgggttgaaacaagaaaaacccctggactagttctgattgctgaattaacataagtttacagcaagaaaatacatgtttgtctttgatatgcacttgttttcattacttttaagtcactgacaatatccctgtcagagacaacttgagggaggagctgttcattgattgttacagattcagagggttcaggctatggttccttgacctcttatagttgggccaaacattatggatgctggaatgtgtgacagaggagcttttgtcccgtggttgacaggtgacagacaggaaaaggctaagagaagacacctgatgtcaaaaccagcccagtgacttcttcagttgtaccatcagctggggtctgggttttacttagaaacctgaggcaaatagatcatattgagaccataaagcactcctaaagtagaaatgttaatagaaaagtaatttattgttgctctgatcccctcttctgatctatttttccactaacaaagttcatagtaatttacatggagtaagtaaatgtaatttgctttataaatttagatactattataacgtattagagtgtgatctccagactgggatccaaatggttaccagtagacactgagatgtttgcattttatactgtttttagaacattcagttatcgagcttttccgtagcttgtaggtgtgtactcatttacacacgtgtatgcatattgagacttgaggttagcctctggtgtcattgggaaaggtgttgtccaccatgttttttggcataaggatctttttcactgtcctggaacttaaactttaggctaggctggctagccagccagctgctctcagggacccacctgtgtgtgtatgctgcacacacgttacatgtttggctgttttgcgtgggatcagattcagttcttcatgcttgcaaggcaagcgctttgccagcccagagttctgccttgccctgtgaccttttgtttcctactattcttaattctgttgttttgtttctcattttatggggggaggttttgaggttccttttttggcacaggtgtgtggcttggttttgtgacaatttcttaccaggaggaagagctgcagatgcttgagttcccacttacactgtgtcctgtctgtcacctgtctccctacccccatcctcagtgttatccttttcgttttagttcgttagcatgagtttgagtgtgttaagtcctaaaatagccattttcctataattgtcagtgactgtacacaggaaaatagttatcattagtaaagtttctctatgctatctttgaacacaacatcacagattaaatcatgaatatttcttattagtaccataattttatgtttcttgttcatagaaaaacatttaaacttgtgatacatgaccgccatgggatttatttgccagtgacggttcttttctttttgcaggcagtatttgacctttcaccccatcagagagagtggcagaggtaaagtgtgaacagtgtcatcaccagagaaacctagaccacttttgtttgctggaatctatgcatattttaaagtattttagtacataaacaatccttatgacctcaaaagctatcagatcttaggaaagtcacacataatctttcctgtagtatattttgaatcataaataaattttagtttttatttaaaattttaattaattaaattttttttttaatcatgaaagtatatgaacattgtttagaatttggtttggagcctggtgtgatgatgcttacctacaatcccagcatttgggaggcttctgccaggaggatcgtaagttcacctctttcctgggctaagtagtgagtttcaggacatgggttaaatacagagactatctcagaaacaaaaggttcacttttcagctttttcattctgggaattgccaaaccttgagtgatgagagccatgtgtgactccctaggaactttgtgttcaagaaaaagtgttttccccatcccattttggttcgcaagatggtttatatttaaggttttctaatttcagattattaccagaaatgtacttaaacgtctgttttttgttttttgttttttttttaagacagggttctctgtgtaacagccctagctgtcctagaacttgtaaactcacagagatccacctgcctctgcctcctgagtaccgggggttaaagatgtgcactaccactgccagcctgttttttttgtttgtttgttttgttttgttttttttgttttgttttttccttcagacagtttgttttctaattcctgctacacttgaggactctttttctttaattaccaatttctctggttggaagaatcttactattgaaattgaatatagttgaataaaagcagtgaatcttagggctttctgggtatctagcactttaattagagaactctctctaaagaggaaatgttacttttatccagaaatattgaagtgtggtgcatacttgtaatcccagtaattaagaggctggggcggggaactgaacccagtactggaagagcagagagcacttttaacccttgagtcttctcttctgacccaagctgactccttttatctagaattctattaggtattgcagaggagtaatgattgggggcagagaccttattaaggaagaggggtttctcatcgtgcttgggctttctgcatgccttcatacggagttcatacttggttgttggttgtgttccaagcagaagtctcacacagtttcctcaaactgctgccatccattaagcttaacttgaacttttgtagacttagaaaagatggaaagctctcaggttctgggcttagctccaaagtttatgtctttagatatataatctgctttctagatctttcttaattattatgttatgcttctaaatggatattgtagtgtagtgggaaaatctacaaggcctgtcacttcctaataaggtacatactagaatgttctttacctttggaatttgctctcttggctggtgttttgccttaaataggatcacaatatttttaaaagacaatttcaaaccctggacacagccttttgggatatctgctttctctttctatatttaaggtttatttcaaactaagtttattgtgtaaattcgatttttaatgttaacaaaacaggcctgttaatccagtattctagatggatagtgcataaatatttttctcatttctgtgtttatacgataattttactattgcgatgaggtatggtatattatgagataaatagttgtgtttttttaagatcatatgtttacatatgtttacatgtaaggtcccccccacccccctacttttaagttcactattagtgtagtttaagttcacagagaaggtgagtggaaagtgcagagttcacatgtctcagtctcctttatcagcatcaggcaccagaatggcttacttgtcatgtcaatgagactgcatggacccagcccaacattactgatggtctgtagttcacttgggagctcccttttggaggtctctctcttgagtggacagttgggtaatgatatatatccaccattgtaccatcaagagcagtttcacgactctgaaagtcctcgctgtcaccgctcatttctccccagtgtgtgtagtttgtttgcttgctatgctgtgacttgaggtgttacttatttaaggtcatgatgaaagagacgaatctaagcattgttttatgttttttaagatttatttttactgtgtatgtttgaacatttaaaaaatttgtagtttttagatttattttatgtgtgtaagtgttctgcttgaatctatgtctgtgtgctgtgtgcatcctggaactggagttatgggcagttgtgaatataccatgtgggtgctaggaatcaaacctaggacctctgctggaacaccaagtgttcataatcatttctctagccctccgtgtgtgtgtgtgtgtgtgtgtgtgtgtgtgtgtgtgtgtgtgtgtgtgtgtgtgtgtgtgtgtgtgtgtgtgtgtgtgttgtgtgtgttacctgaatgtgtcttgctttacagggaagatgatttgttactgactccagatgcgtgcagaatccacggtcatctatatgtcaataaagtagcagggaattttcacataactgtgggcaagtatgttcttttcacttcctgaagttctttaggtggggttggagcttgattaaaattactccttttcctagtacacaaccaccacaaagggcactttaaagtgttgtctgtgagtaaataggaattaaaacctcttaatggtaacttttgtagccagagagcctgaccctagatgttccatcagtgtcttcatttattgatagtaggtttttgttttgttagccctttggtagttctcataaaaaggacttcccttagtaattctagaaaaactcaaaagttactaatgtgtagtatgaagtaatttaggcaaaaacttaggaaaactgccactatcctcctgaatataatccagcatcacaaaaaactcttggtagatctcaccatgggtgaacatctgctccccagcttcctctttccagggagacctgatgagctcttcactgtctcagccattgcctgaatacctgatgtgtgcagagtactagtataggggaacctgtagccagcccctaagcgggcgtggctacaggttcccctacattctagcctggagactcagggtcaaacagtgaaaagaggaagcctttactctcctgcgtgctgaagtcatacaagaatattcaaactttgaccagtaactacattagctgttacttaattatagttgtattgaggctgtagaggagatatatagccgataagaaaaattttgacattgtctacaagtcagcagaggcttcatgaggaaactttggagttgtatggggagttaggagttcacatcgaacagagagcatgtcacagaagagaacttggcttcaagggtggctttggtttttttgtttatagaaagagaacattagatttttatatatattttttgttggttatttttgtttgtttgggttttggttttttagagacagggtttctttgtggctttggaggctgtcctggaactagctcttgtggaccaggatggtcttgaactcacagagatccacctgcctctgcctcccgagtgctgggattaaaggcgtgtgccaccactgcctggcacatacatgttttttttaatcaggaaagtctttattgcttataataatcagatcaaaatttagtttttctttgctgtgcttttctcctgcaaattcagattttgtcgtttggccactgttgagtgttcatttaccaaatgcagatggtcctagggactttgaagccttggtacccatagaggcagctcatgatggagaaggcttcttcagctttccttgcaaacagtgccctagtccaagaggaagcacagtgtgagcttctatatatggcctatattttatttttggctgtttttctccccaatttcatacctttcagcagatggtaacatatatacatacatacatacatatatcaatcagaccccaaaggaaaagcttttgttgtgtctctcaaactccagtggacttaccttttctttctttttcttttctttatttttttgtgtgtgtgtgtgtgtgtgtgtgtgtgtgtgtgtgtgt

SEQ ID NO: 37 - DNA, 631989 bp, Cricetulus griseus
  modified_base (27435)..(27483): a, c, t, g, unknown or other
  modified_base (115988)..(116163): a, c, t, g, unknown or other
  modified_base (178045)..(178291): a, c, t, g, unknown or other
  modified_base (210690)..(210717): a, c, t, g, unknown or other
  modified_base (231990)..(231999): a, c, t, g, unknown or other
  modified_base (257630)..(261324): a, c, t, g, unknown or other
  modified_base (264590)..(264614): a, c, t, g, unknown or other
  modified_base (271207)..(271462): a, c, t, g, unknown or other
  modified_base (309069)..(309169): a, c, t, g, unknown or other
  modified_base (322641)..(324219): a, c, t, g, unknown or other
  modified_base (334465)..(334495): a, c, t, g, unknown or other
  modified_base (350232)..(350241): a, c, t, g, unknown or other
  modified_base (356267)..(356374): a, c, t, g, unknown or other
  modified_base (364325)..(365335): a, c, t, g, unknown or other
  modified_base (388535)..(389136): a, c, t, g, unknown or other
  modified_base (431575)..(431707): a, c, t, g, unknown or other
  modified_base (465258)..(465288): a, c, t, g, unknown or other
  modified_base (465497)..(465701): a, c, t, g, unknown or other
  modified_base (540074)..(540237): a, c, t, g, unknown or other
  modified_base (543149)..(543265): a, c, t, g, unknown or other
  modified_base (585616)..(585695): a, c, t, g, unknown or other
  modified_base (615469)..(616634): a, c, t, g, unknown or other
  modified_base (617073)..(617179): a, c, t, g, unknown or other
  modified_base (617512)..(617652): a, c, t, g, unknown or other
  modified_base (618244)..(618267): a, c, t, g, unknown or other
  modified_base (618400)..(618438): a, c, t, g, unknown or other
  modified_base (618684)..(619156): a, c, t, g, unknown or other
tgtatgatttcttgctggcgagaaatacagagcgcgcgggacactccacaaaacctggcaactatcctccatcatgcattggcaatagtattcaattctagtacacctgaaaagtactatgtgaactccaataaatgttatcaataaaagatctgcgccttggtacagtttctttcacattttattcttacagatgtcacttgtttctcaagctatttagtcccctttaatgagtttgtttcagggactgggaaagtaattcagttcatagaatatgctaggaagcatgaaggcctgggtgtgaccttcagtaccaaataaaacatcatggtagcataatccccatagtcctagccagcacttggaaagtaaaggcaggaaggttagaaattcaaggccatcctggactacactagcaagtttgaagctttgctacatgagaccctgtttaactaaccatacttacaataagtttgtttcatacattttagtgtagttaaattgttttggtgacactctgcattccatcctgggctctcctgctgtggtaatttgaataagaatggtcaccataaactcatagatttcaatgtttggtcaccagggaacagcacttttaggaggtgtggccttgttgggatatatgtgtccttgttggaggaagtgtgtcactagaggtgggctttgaggattcaaatgatcaagccaggcccagtgtctctctcttcttgctgcctgaggatccactacttcccaccattacaacaatgaattaaacctctgaacctgcacgccagccccatttaaatgttttcctttctaagagttgccatggtcatggtgtctcttcacagcaatagaaaccctaagatgcccatcattgatattttttgtttatattaaggtttacttaatgtgctataaacttctatggcttttgacaaccccaagctgtcatgtatcatcaactaacaaatcataaatgacattttcaccatgataaacacacagacacacaaacatgaggatataaaaagggtgcagaagccaactaagacagctaatactaaagctaaattcctaatgctttgacaacaaaatattgttagattatttctcaaagtgaaaagcagtgtctttgtcttcataaagatactagtaaatgaccaaacaaacaatagaggaatacaaatcttccgtgtaaaagaattccaatttatgtagctcctctacccaccaggaagcatgcaggcaacccctgctccttaactgttgactaaacatcttgccttccttccaaagactacagtatagaaaaaggatgaggaaagataacttcacagggaagaaagtgaccaacacagctacagctaggagatgaatgtcaacatcagcagagtgtaataaagttgataggataaaccctttgtatcatgtgatggagtggcacttcacctgtgtaatcttctcaacactgtaactttaatgatggggaaaacatttaaattccatctatgggacatctacaaaactcctgaccagtacttctcaaaactgtcaacatcatcaaaaccagcaaagtgcaaaacactctcgaggccaagaagttaaggaaaacatggtgaatgagcataatacggtatcacagatgagaagctagaacagactaggtagcaaagtaaagggggaaagtatataaattcaaaactttccaaaaaataagctttactattaaaagataagagtggcagccaactgttcataatctgtgtccagtaaatagggaactgatactgttaaaggatgtgcacaccccttgccagacaggttcccatgcagggaaggtcattcatctcagtccagccagctgggatgtcaccggcaaatagatctcagtaaccacgtagaccctcctagcccattcacccttttcttctcaatttctacacacattcaatttcacttttattctgttgttgttattatttcttttaatttatgactgttgatcttcttatatttcagacacaaaacttcttcagtaataacttcttattctcagggtgtaaaacataaattctgttgattttcttgcccacaactgaaaaaaggagccctgtgctgtaagactatcttcccgattccacacactggaagttgcaacatattgttctaatgaattgctagcatttgtactgttcggcatggaaactctaatttcctgaagccctggatccaagagatgaaccactggatggttaaatgaaggaagcaaggcggcaggcaggtaagaaagtaggaagataggaaagaaggaagaaacagggagggaacccaaggttgaattcccataagcacattcactatgatcaagccagctgccaaggagctctcagtaagaaaatgctttaaaattgctgggacactagagtacttcccacctgaagaagtgggacaaaatctctgggtgtcactggaaccctacataaaacatgttataataccactccaagacatagtccattttttcctgtgttttgtgttttatgagttagttgtattttccttgactagttgtagacatgtttgaaatttgtaaattaatcatttaaacatcaaaatcaaagcttctttgtgggtagaaccttggagtttccttatttactaagcttgtttcactccagaatcctggagttaagggttttgtttcagagaaggaaaactttatagagttcagaggaagtattgtcacagtttctcctgctttcagttacatttcagaaacatattttgttgggaaggtgaaagaaaacagcaatttagagtatacttaagatagagctggtgcctattactgggcatccctgtaatgtttttatgactttggtgtcaacatgcacccctcccaccatcccaccccacaatccaataaatgcctactctgagttgacccatgatctaatggcccatggtagccatttgatccttcttagtgtttaacataattttttcaggttttattatccaactcaagtatttcagaagtttccaatcctctttctctgaaaggccttcacattttctgtagactctcacatggaggtgatgactgttgggggcctgcaaagctaatatgagcaggcttccactcattcctttcttggtcactggagataaaagtacaactccatttctcagcggcaaaggtactgaaatccaggaaggttgtcactgatctcaacatcacggggctttggaaaggactggagctgtggctttcagctgtggctccacctaagaacaacctggaaccctttgcaaactcttcatgtccatgttccttctagaatgatcaatccaggcttctgaaccttagggccagcgtcagaatttctacagttctcattctgatgtgtaaactaaatttagaataatacagcaacaagttgattagtaactaaccttgagtggttttcatgccattctttttatttccttttttgtcttacatctttgaacaaacaatatgaagtatgttaggcccatcacaatagcagccagcatcctaccacttaacaatttcacaggacttttcattggaagaaaatatcacaaaatagattacatacctccagcaaagctgcagtttctttttgctttctaagcctccagaatacagtttatattaacctaaatcccccaaatagtctttcttttgatttatgggatgaatgtttgtcaacaaacactccagtaatctcacttaaagaaaactgtgggtttttttccacattcctcaagaagacttttacccaaacaaggaagccacaaacacaaagaggcagaactcagcaagggattcacactgaccttataataaacatgcagccaaatgcctaggccagcaactttttttctaccagaagctatttttaaaacatcaacaaccaccaccaaacttcactgcaatgaacaaaagggattaaaagctgcctgaattttatgcaaataactttgtatttgcaatacccttcttggaagacttctctgtccccaggctctttacttcatggatgagattattttgttgtagagcaatgccacccacatccaccccaaaactgaaatgtaaaaagaaaagagaagcactcacaggagtatctgttttatagcccaggccatgatgagatctgtcaaaaattaggctcaaaactgattttctagaagtccaagagccttgaagatctcttttccccttctttcccttcatatttcatacagcagttccaaggccttcatggagattgtgcagagtgaaatagcagtggtgtgtgtgtgtgtgtgtgtgtgtgtgtgtgtgtctttctgcgtgtgtggtgtatgtgtgtgtgtgtgtgtgtgtgtgtgtgtgtgtgtctttccacttagaagatcccctgatgttttcattctccccttcatgggtgattaaaatgagcagttttatgagcatttgtagctcagtaactacttccaaacatttacattactataagtagatatgggaagccacttaactaattctaattattagttgttggggatgggggggcagtactactgatggcattctctgtgtcaccacgagaaccaagaccaacatctttaccagacatccgcaacagagtccttgacagcatattccaccctataccttcactttctgcttgctttaggggagctgttccatcgggatcatcgttttctcccacttccctctgctgatatttccactaaacgtttcaagaggggcttggtaggtctgcgtcttgcaggttgagaaatcccagcctcagaactccctgcttgcctctgattctgcttgcttcccttccagaatggtcttgctattctgtttagttacaaagtttggtctttgactacaaccagcttcagttcatctgttccccctggtgtcctccctctctgtcccaatatccaccaaaagttttccattactcatattatatgtaataaacaataattgaaatgaaatgactcagaattatggccagtgagctgcagggtttaatcccagcacttgggaggtggagacagaaaaatcaagagtcccagttatcctcagctatttggtgagtttgaggccagcctggactacatgaccccctatgtgaaaaagtacaacaacaataaaaatgacccaaaggcaatggtgatcaatacgcactgtataaatgtatggaatgttcaatgaataaaactattatttaaattatttttttaaaaaaatagggaccagagacaatagcttagccatcaaaaacactgactgctcttccagatgatctgaatttgattctcagcacccatatcaggtcacaactgtctgtcattccaattccaagggagcgatagcctcttttggcctctgagggcaccaggcacatatatggagactgcatacattcactacatagttcaaagacatataagcaggcaaaatacacatacacatacaataaatattttaaggcaaaaaacatgaaaactataaaaaatgaaaaatataactcaaaaattttaaataatagcaatttgagccctggcgcgagctggccatgtcactcataacatctacaatgcatgcccattttccttttcttcttgaaaaagcattcatgctctttgtggaaaatatatacagagcctcttaagttgctttcttatagagaagttacttacgggatttaatgaataatgaaggatgaaattacattgcttttctgatctcaactctgttaaaaagcccagggagtagatacatccaaattcagtaggaaccatcttttcatttttttccacgagtattgatatcttctctagctgtagaagactagttttctccaaaagtttttaaagttttatttttttaaacttatatgcataaatgttgtgcttgtatgcacatacgtgaaccatgcaatgaatgcatgcagtgtccaaagaggccagaagagggcaccagaaccccggaactgtattactgcaggtgctgggactcaaacttctggactgcacaaaagcagcaagtcttaaccactgagccatctccccggtccctagccaaagtcttatttatcaaaatgctgtttaaaatctctgcactttgccaatcccactctctgccagccagatctgcagcagcagataagagacagcttcatgccagacttcacgatattcaagtttcccaagatgaatgccaaccgattccattcaccaccccacccccaccccatgatgctttccatcccttaccaccaccatcaccaccccagggaaagttaagacatgctcccgtggccttggcttgccagctcaatttcaccagtccctcgtattttttccatgctaatggctacatgacacatacatattttgactccagtgattgtccacatgggttcctaccatctttggtccaatgaagagcatgggtgacaaattattgcaggaaatttagcttcagtgagagtgccatgtgttgtgggatatttgatcacactgtgaatcccgagttttctttaattaaataaaaatcaaccttgtttcaaggggcagaaccagcaactagttcaccagaattagccatgaggagccagaaatatggatagagagacacacaggaaggagtaggaaggggacttggagttttgcagtcttttttgtttgggacgaatagagagatgcatcttttgcagggtctctggccaaaaagaaggtcagctggttgcttcttggcctcgctgatctagcaggtttgcacccccacatctgacttctgagtctttgttggtaaatagagtgatagaatgacagtgacttagttaaaaactgcatttggtagccctggccaagctggggctgtgggacagaagtccttccaggccgaagcctgagtggcaggtagaatgctgactgctgggctgtgaggcctcagacagtaattaaaataccagtagatttatgtgcagccactaaactgacagaaaaacatcagtcaggatatcaagtgtgtgtggtccatgcaacctccttcatactctagaactttcctcgtagacagggcagaagcttttgtgtttcagctaagacattgggactgtggattcaaagaggaacttaacttcagctagaattcttaatttccaaacaaagtcaccacgagtgaacatttttagcaggagtttgacaaacagcaactgatgaagcagcctgcttcgtggctggttctgcgtggcttgtgtatccttgtggccaggattccatgactctcaccttcccactgcaggtcccacagattgaaccctcacccagcagacgttccctcctaccctccctgccatagtgctgctgcccagcttgaccccagctctacttgaaggtttgaccttgtttctgcttctcacttagtcctttggactcaacccaatggatccattcttgcatctcactccagcactgaacatctagctcctattcttccactgcctgcttcctccagttgtgttctactgtgaaggaatcccactgtcttctagtggtggctataggatcagatcccagccctttgacagatgagtaaaccctattcctatagtttctccagacagcagtctgaggataactaagaatgcagtccaacatgaaaccagaagcttactcaaaacacagaaacttttttcataactcaattgtgtgatagatgacaaggttgggcatgtttgctaatcatccacagagaacaaggccattatacctggacttactatcaatgtcaccacctcaacagtgatgtcaactactcattctggcaggtctggtgcactggcctggatgagcttaccagctattttataccattataattcctacaattacagccattgctagaatataaactaacagccaacatgatcctgatgcactaaggggggtcatgaggaacttactgaagcctgacctgtacaatagaataaaatcaaattgaactaagcctgcacctctataaggattcaggcattatgctggcctgcccctgccactggcaggatgcactcaggcagtaccctggtcagcccaggggtccatgaatactagtctccgcaagcaggtgcaaaggacccttttaaaagacagaccctgcccacttatgatctctttttctcttctctttcctctcttctctctttctgctctcctctctttctgctcctgtctccctcttctcttctgtcctctgtctctgtgtctctttacctcttttctctttccttccccctccctcccctttctaataaaatttctcactcaagctctgtctgcctggcgtgtttgtcccctcacctcagtcaccctcgctgatacagtttacaagtcaacactacatttaccacagaacttaaaataatccaatacagcaaagactaacccttctatcccacagccttcatccgcacttcctaagagtctggacagagtaccagcacacacaaaagactttgttttgaagtgacctctgttttgaagtttcccatccctgcctctgacttctatcggcctgttgctcgctattgctgccctcttctctcagtggttctttggtttggtttggtttggtttggtttttttcagttttttgagacagggtttctctgtaggtttggagactgtcctgcaatgccctttgaagaccaggctggcctccaactcacagagatccacctgcctctgcctcctgaatgctgggattaaaggcactcgccaccaccacccagttcttaaagtttcttcttatttctttcataaaaccaggagggctttcccccctaattaattcaaaagttcaaataaacaacaaagcaaatgtgagagtcagaaaggcatatccacagcccttttcataaatggctggatgtcttacttgtctctctctctctctctctctctctctctctctctttaatgttcctcttcagatgtaatggtatcactaaccaagcattcaagcaaggctaccgcagttctactgcagtttacaaagtgaaaatcttctcacccaacaagtacaccagtaggagatggggacaatttttagagccccaaattaaaaaataatcccactatttaatacttttgacagccaacccttcctccaccagcaatttgtctgagtaaacattcttcgaagctgacatttcccaggggtgtgatgcaatccatagaggagacatcctgtgtgcgtgaataacagccgtgctcccagctctgtggcccataacagtcatccattttgtaatgtttgcttttttttttctccttcctcttcctctgttctgagctctagaagtaaattaccattctcacagatgtgtgcccagtgtacaactaagctgctgttccaagtttagcagcacctcaggcagggacatccagcaaaccgccactggctaagggccaagcccagagctcaaccaacactgcaggcgcttcctcctggcctcctctaggctatgggatttcccaactgttgtaacagctctgacacgtgtctatcagggatgccaaacacaaccagaacctccaggaacccctcatgatgcctccggaagttaattgcctttgctgctcaatgcactctcaactctcattagcctgggcactggcctcagccctaacctcctcatcccagggccagctccaagtcggctctgctcttgtgtgctctccgggtgtgctaggtatccactgcactgcacctgaagaaggctcatgcacatcccaggcactaggcatccgctggcagcctggcccacgtccttctaccccaacaacttcaatctactccacttgcctctaattccagtgacatgtctgtgacacaaactaaccttgaagaagtagaaactacctggagtggagactgtgggaggagcccaggaaatggagaataggacatctgggagtagataagaatatctatgtccatggaaagaaccattttatcccctcccacttaaggggcccacacctccaccacagcatctggtcttctcctggacctgggagttgggggtagaacatataggctcatctgtgtaggaacacactgagcagcactgtgaaacaggcagaatataccccaagtctagtcccttacttccattccacgggctcaggggtgcccctgaaatgaagcccccccacacccgtgcccactacattgagataatgaggtaactatgacaactaccataccaaagtttgtcagagggaaactcctcagccaacattttgagttcttcctgtgtgttttagattgcaaatggatgttgtggtgtgatgactgaaacattaaaaaaaaattgacctaggtaggttgaaagaagtaagcgaggttcccagggaggaatatttcatactaaaatgtgttttctttttattcgccatgtatctggcccacagtaccctcgccccttcccctctctggctgcagaaattggagcattttggaacatacctaaatctaggtggtcctggtcttcgtgttcgttcagtccatccagctggcttttggcacactgaaaaaggcacaggagaggcagttcattgaattccatcttaccacactaatgtttatttcttgtgagttgagatgacgctcttggaaaacatcaataaaaccacatcactcacatcacaacacacaaacaggaaattcatctgtgttcataattagcactgagagctaaaaataagtaaaggatgtgtgtccagctaaaacacacctgaaagctgcccatgggtaaagcagtaccagcaaacagccatgaatgagacaatgccaggaccgtatgttctggaggatactgtcaaacagtgacaacttggaaagatgttgaggtttggtcataaaagtgtagcccattgcaatcctaataaaataaattggatttggggcacactcctgcttacttgtagatttttatgaacactggctcaattgtcatgtctgctttaacacacaaggaagacaaccatcatcccttacctttccattgtcctcctcaggtggaggtctgccagactccaaattcttaatctctgcaaaagatataattcttgttagaactgctaaacagagcgttagtttaaaaaaataggaaaacaatgaaagcagatgacaagttataagcaaggcattagctaggtttttagattagactacttaacagttgaccctaccagagaataatgtattggtcacctgaccgaacacacactggtattatttgtgtacactaagatgtaaacaggcagggagctgtcactggaaatcttggagccacagggctggggaggacattaaatacatcagtgcccttcacaacaaaggaaagatgctcatccccaaagcttcagcatagatgctgaagatgcaactggtgcccacctgagcaaatcccactcgtctcttcccctggattccacagatggcaaagggagaaagaaaaaatgactaattcattctcaaagagacccagctgtcccttctgaagcactgtaaggggagcacgccacacagccctcagcaccgacctcaactggccaggctggctaagccgtgactggccccacatttcccctcacagcaaagctcttcctggaagcaatgttcaggatgttctgtgatgaacatgaaaatccaggtgaggccgcctttttctctgttccttggctgattggttctcttcccaaatactcagtttcccagaaacaagctttaagactatggaaatagttacagtgtgcaggtttaaccctagggaaagtaagtgctgatatccctagcaggggcaaatagctgaaagtggtctgtctgaatttaaagaaatatacaaccttctgggccttgggatctttgctggaatctcagcttcccggaccctaagtacctttttgatatggtcccagagaaaagccagaaatttccccagaaagttcataaactggacattccctacccttttgtctctcctgctaatttcagttgcctaccacctcaaacttccaagtggacttattcaagctcttcatactctatgtggtacagtctatatttctgcacagaaaatgtactgggccttatttatatggctctccatgacaaaccagacaataagggtgatagatcgcaaagatgggacaggaagtaatggggcaaggacgaagcagccacaaccccacttgtcaaactttttaaaaatacttctatttttggttgtgagcctagcatttagcagatgagccatctctccagcccttttttaatacttaagaataactgaatctgggctagggggatggctcacatgccaagagcacttgctgctcttacagagaacacaagttcagttcccagcgcccacagatgctgctaacttcagctccagggcacctacacccttttctggcctctactagcaccctcacatgcatgtgtgcatacccacacacatcacacaaacatacacataagtaaaaaataatttatttttttaaaagaactactgaatttgtctcatatcaaccaagcaattctacagtgtcactggacaactgtttatcgaccatgaactcataatgcttattatgtttcatgataaaaatgaaaacataataacctcaattttatgcggttgtgtcaactctactcaacagagaatagacacaaggtactgaagtcctgcctggtagcttatacaggtagcatcaatgccagcttttacatgcacatcacaatctggcctcggggtggcggaagagtaacatttgcgtaaagaacagccatatatgtgaaaacaggccagttttgcctttgagagtgaatcccgtttcagtgccaaaagtccaaagcaaacaaagcaaattttccagtccacttcatatgcacagaactggtgtgaatcacctactatgatgtttgccatttaggtgttgctgaaaaatccctttggaaactcatacctacaagataaaacttcaagtagagaagatagctacaatgggtccaaagagaataaccagaaccaagatcaggaacacatccgcaccagagaggaaggagaccatgcaattccatcctgctggctacagcctatgcccataacaccactacagaccacggtattcctaaagcattccatacatgcaggcatttattctgaagagcgtcctggaaaacaggatatggcctgttatccattggctttcttcctcagcccaacccccaaatgaccatgatcttggcacatttccatccccacattttccccttaaagtctcctgtgatttttttttttattttttaacttttaaaataactgctgtagaaaataggacaaaaggaggtaatcatattaagtgaaagaagccagtctcagaaagacaaatattatcaatttctttcatttgtggctcctagattttataaacatgcataaaatcatgtatgtatacatgcatgtgtgtatgtaatggaagaagtaaaactaggggcaaagtagactaataagactgaaggaagggtgaggaaagaaagggtaacggcatgggaatagactcaacataatatctacttggtaaaaaacgtcaaagacaaaaaaaatttcaaatatttttaaaatctgcactgcctgtaacttatctgcattgtaattacttttaactttaaaactaactttcaaatatataaaaatcatcaccctaaaattacttaattttgtgaaaatgtgaagcctctgattcataactcatctttcattaacttagaggcactaaccagaatgacatctcagggtttctcagaaaatatggtgctcattctactggggtttaattaaattgctccaggagcatttctgctaaattagtaggctccttttacactagcccagagtaccaccaattgcacagtgcaatcaaaccactcgttgttatagcaacctttggttgataatagtatcagtaactctagctattctgttttaagggcctgttaacattgtcttcaaggtccacccacaaggaaggattacatctctaaatcacacttaccaaactcgataaacatgtttttttttttaatattgccaaactataataaaatgagataatctctagtacttatgttcactaatgacacagcaccaacaaacagggatttttaccccagggataagtagctgtaaagttaatatctgtttcattaagatttccctggagaaaagctcatctctgtgtataagctttattacctctgcttgccaaatggagccagagtctaggtttaagcaacaaaaagtgagtcagaactctctcaacagccctatggctaaacacaaggaaggagcaggagaaaaagctctcaccagagctaggctgcccaggagtacagccttctactatcccattctacaattgatggccgcacctaactgagaccagcagagatgtcctgcacatagctggcaagctggtggcgataaccatgtgctctgcctccctaataaataaaatagcaccctagtgatgctcatcctcaccctacaacccctatagctatacactaattcatacataattcaatgtcctcttgagtgtgtgacacaagcctgtaaccccagcactggggaggctgaggcagagggtcacatagtaagttccagaacagcctgaactacacaaaatgatatcctgtctcaaaaaacaaaaccaaatacaccactctttgaatgggtccttgtctcctcatgggtactgaatgcattctggaaacggactttgggttggaaccaaattggtctgtgaacccatgattgtatcccctgcctgttacatgcaaggtggggaatcaacaaatcccccacccacctacatttgttgtccaaaatccatccatctgatgagatatagtgggtgttgggccagctctgggtggggagagagaaggaaagttgcttgctttattgaattgcaaattcgaacacttgcagtcccagcactatttcattactacagttctggccaccagactgactggacagaccagggttctgccccctgcttcttcccacacatgtagccctggcacctctcttgttgtgcaccaagatttcactgttgacttatttacttccttctatggcacacaacatgcaactctcggtgccagacagctaacgtggcaaaagagacactctaaattcacaaactattataacacttgaacttcggttaaattcctccccttttccccaaataggaatattaatgagaacactcatgttgctggcccagcacagtataacgtgggggaaacaatgaagcagttatccacaaaagtcccaatgagtcttttcctccaagtgctcaaatattacaggcaatctcacaagctcaaatcattccaatgaagctacagcagcagagataccaatgcaaagatggaatctggccctcaagtacccccctcccttgtgctggctccgggtcattttatttttatatctgggattattcggaatgaaaaaggcatcttctggaaatatttttatctaaattattcttaatacttttttctaagctacaacagtaattgtttaagaaaacttgaaaaataaatatcaatataaccactattaaaggagaatatagcaaattttaatgtatgttatgcttatctagcctagctggagtgtaatgcatacaccacactactcatttgtttaaggcacacgcacaatttgtttagctttaatatggtcaagatgtgcaactattacccaccattagttttagaacattttcctattgtcaacatgaaaccccacagccatgagcaatcactctccatagttcttcagctgctctctgacctcctttccacagcccagccctggcaaccactaccttaatttctctcagtggtttgcctgcttaaggtattttatacaggtcgagtcatgtgctcttttgtaattggctttataaacatagcagcatgtcttcaggtactctatcagtacttctttagtttttaatgattaaaatctttagtggggggtggaaagatggttcagtgatgaaaaatacttgctgatcttccagagtaccagagttaggttcccaagacccatgtcaagtagctcacaacaacctataactccagttttattaaatggaaaaaaacaagcaagcaagcaagcaaacaaacataaaaccaaaactcaactacagaattattattagtatagatgctccaaattttctgtgcttaagtgaagtaaaacaggatttgccacacaaaataaggctacatgtgaaatatggaagaactgaaaccagcaagcataaatgcaacccatatctgcattttaaaagtattaaacatggggctggagagatggctcagagagatggcttaatttagtcaacagcttaactaagataaagtagtcacctttcaaagagataaagtgtgactttaggattgcttttatcccttgggacttcacttagagtttacttcaagaaaggggttctttgactacatgcttaagataagctatccaaatctatttctccttagctgagttttactcttgtcccaagcctgataatttgacccatctggaagaaagaatctaatttaagagtgaaacaaatttattgccttgaggtgcactatgtggagcccctggcctgtgagcctcataaggtggttcaatcagatggtctgtaaaactagctccagctgaagccatcatccttcaattttttttgatacagtggaaggagagaagactttttgttcatgtatggggaaaagctagtagtattgttctgacagtgtgcaagtgggcctgctctcagcttgacagcctgtcttcatccttggacctttactgatgaaagtaatttccttttaggagaaacaagactggcaaactcaatctctagagaaaatttggagaaggatgtgcttgccagtagagtgaaagaagtaactacaaaccaccttaaaggaacattcactgctgtctttttgtaatttttaaaaatgtattttttgttcttgagggaaccactgcacctatttccatattggctgcaccctcttaatcactaccagaatagttgttgggagaacatacataagacttgtgtaaacccacaccagacaaaatcccagtgtggagggtgggggggatggggtgcacaatccctccctagctatgtagctattgacaactgctagatgcttggagggggagagacagtattctctaagactatggcccctggtaagttggccacattccaatggaagaccacaagtccaagaataaatgggcagcagaaattagtcttgaaggattaaaatttagaacacaaagttagaagggtagggaatgggggtgttgaatctgagaagcattggggagggggtaaatatgatcaaaacaagttatatgaaactttcaaagaactaacaaaattttttttaattgatgcaggcttagatatatttacatgtacacaatgtatcagagaaatctgcatttctaccatgtctttgatttcagagcctataaattcctctttctagttcttaaaatatctaaggtgttataaatcacagtcaccctgctgtgctatggagcaatatgttccttttacatgacagtatgctggcatctgtcatccaaattccccataatatttcctccctctccctgattccccaccttctcagcctctagtaaccactttcccactttttcctgggacatcaactcttgtgactaccactgatggctgagagcatacactatttgtctttctgtgcccttccatttaaaattactaaaaatgcccaaattcctctgttttctcctcctcctcctccttctgtttttttgagacaaggtttcctctgtgaaaccctgagtgtcctggaaccctccctctaaaccaggctggccttaaactcacaaagatctgcctgcctctgcctcttgaatgcagggattaaaggcatgtgccaccacccaccactgtccagcttcctctacttcttagggaatggtactgatcaggtcttagatactccaaactagaggaggaggtggttgtatcttcaactaagtcatcatcttagaaaacagtttcctcaatgatacacggaatccccaacacctcagttcccagctgccctggcttaaagaacttttatcttcatgaagcacttgtaccacatgcaaatattctaaaaagccctgagttgcagtatttaaaatgaaacatctcagaaaggaaactttttgtggataacagccctcttactctcccaatactgtctcatgggaaatatgcaaatatggagcaccagtcactcattcctccacaaaccacatgaacaattcaagcaaagaatctgctcacttccagtcacataacatacttctaccactacctacactccagtataggctggagttacttaacttacactcagagccaggcaacaggcacaaggccaccactacacaagagactgagcaagtgcctcaccttgggtattaaatgacaccgcacctctactcccctccaccctcctctgccatctccacacaagcacacaggcctgagtagctttcataatgctgaaaagctagttagttcaagtccacagcagagctgagttatgagctgtctgcttgctgtctagcagcatgtgtcatcgagacaagtctgagcatgcgggccacaaatttcctagtgacaaaagcttgagattagcatttctaggcaatgattctgatgttacactttttccatcacacaaacaccagcgaacattcgagaccagcagtgtgaacattcaataaatagattctctagtctgggagtggttgggctattggagtgcagtgtagataaccagctgacttctcactgcctagacaagacatgctacttaagaaaatctcttctgcgctactcctcatgaagagtagttaattcctaattctcagaaatgccccttccccatgaccactagtgtgtgtgctccatgagtacctagagcttccttgggttcatacagactcagtgcctgggacagggcctggcatacaacaagtgctcaaaaatactggaggaaattactaagagtagagttgagagcagggatcttgtagcttgcttttgtttgctgctgattctgcaggcctacaatagtgtccaatacaaagtaggcacaaaatacattgttatatatggtgatatattattcatgatttattgataaagcttgcctgaggatccagaaaacaaagtcagcctcaagctacagagatcaggaagtggtggtacatacctttaatcccaaaactcaggagacaaaggcagatggatctctctgagttcaaggccatccagggctacacgagattgaatcagtctaaaagagtaacgctttaatcccctcaccagacaggtataaaatataggagcttgggtcttcagagtcagtctcaggattctccagccacgttgaggagagtatagaagtctgggattgcagtctgaggtgttgtggagccaggatcgcctttcagtctgaggtaagacctaactgactgttttgcttttccgatcttcagcttgaagcttgaacctcaatatcagtctctgggtcttttatttaattgtgttacagttatagaccatgcaaggagagaacctacaggactccagctacctgcccaggctgtgtcttgtggtgagttcttggcctttctcatcagatccatacaggtaaacagctgggacagcccagtcccaaaggaaacagctttaccctgttggaactcatgttccaatccccatttcctgtttccttgttaatgaagctatggagggcaatattacgggaaggagctattataataaagtcacagaccaatgacacagaagtgagacagcacaccatacagatgttttgttccatctacaaaaacaatttttaatgaattaatatgatcaaactatattgtttacatagaccataatcaaatccactcatttgcatagttaatatatggtaataaaaataaatactaaaaaaatgaaaaagaacctggatttacacagtggtacctgggctgtaatagttctcagcttgcactatgaccaataatttccaagcaagcaaggcctcttatacaccaaaaactgtgaaaaccaggtgcagtggttcacaatttaatcacagcattcaagaggtagagaggtgaagtggcctcatatacaggaaggcctgggtctcaaaagcacaaaaatatacagggaattttagcagggcattgggaggtgcagatggcctcacccaaacaagaccaccctgagtggtttcatattcacctccctagaccggtagcagagaatgctactgtactgagagatgctgaaaatcaaggtggcagtggaaaagggaatgcagtgtgcgaaagggtcgggggagatgttcactggcatcaacctccagagtaccttcctcagaccacctcctaaggatgtttcattgaccatctgagttgaaggaggctacacaagttcctaattcttgactcactagaatctgtgatgcagcaaatgcattccaagtctctcagttaggtctcacagagagcattttctatgtatttggtggaagagtccttacttttcagaacatcttctagctcagtgtattgctttgcaaaacattctagggtataaagtagacacggtggtgcacacctgtaatctcagagcttgggaggtgaggaccggaagataataaaattaaagtcatccttggctacataacaaatttaaggccagcctggtctacatgagaccctttcacaaggaattggggaaataaaacaaaagaaaatcctagagtaaagggactgttaagaataagactaaaaaggctggagggagaatggagcttatttcttttcaaatggtctatggcggtctgaatgagagtgggtcatgtatttgaatgtttagtcaccagggaatggaactcttcgaaaggattagaaggactaggaagtgtgtccttgatgaaaaaggggtgtcacaggggggtcattgagatgtcaaagcccataccagtcccaatcattccctccacccaccacccttccctctctcctacagaccagcatgtagctctcagctattgctccagcaccatgggcactgccatgttccacaccataatggactaaacttctggaactataatctagcccccaattaaatattttcttttataaaagagttggcttgggcatggtgtctcttcacagctaaagaacagtgactagacagagccatttaatttgttcagaataacttcccattattcttcaagtacaattgcaatcatgaaattataaaccataattagttcacaataataataataataataataataataataataataataataaaatcatttatcacactcacaaagacagcaaagttaatatccaggctaaagttattacagttctctactctatgacagcagacacaagttccccagcggactcatcaccacagcagggagaggggtgcaatctatctaatcaccaatgcacctcaaagagacaggttagtgtcatgaagaaataaaaaaggacacttttatcttaggatgcttgttgagtcttgtgtaggcatcggaaaggaagaaacctaagtgtcttcactttagggaacactgccctctactggaaggtataaacagcttctatcattccttcgatgcattctaggtctacaaaatgtgcctgtcagttatgtggacctagtggacttgggtttcttgccaaattctttcagtttggtgcctgcagtcctgttcacctgtcccttagacaaatcaaactcaatctgtctaaaattgagtacattatgtgacatagacctgccttcaagcccacccagaaacacaccccaggcacagaactctccttcctctccacaacactcatctcactccccacaacattcatctatcccaacctcatctaagacaacattcatctagcctcaccttgcccaaagatggcattcatctagccccacctcagccctggccttactttgccatggtatagcccttctaaatgactttctaaagccctgtagctttccttgccttccatttagactttcaactggaatctccattctcccagagtgacctttccaaacagctgtttaaaacagctcccagaattctcagggagaagctccagccccttgagtctttcggaagccctgtcaatctggctgctctcaagcctgtgttcttggtatttctaccaccacacatgggtgtgcaggtggaaaaatgacctgaatcctccccattcatctccactatctagaatcccttttctcactaacatcctaactccagggacaaatcttccatgacagctgcattgatcatgtcactgttacaagctacaacatgcttgaagcaatgagtcatttgaaaatgactcatagagcacttcccatactctgcttggagagcttgttttcctgtccagccacaactgcaaaccccacacctccgcctcagctcaagaactccagcacttatttagacttccttttattctgaattagtttaaaggtggagaataagggaagaaagaggcatgagctaacctttctaaaataaaaaaaaaaatcagaagttgacttttaaaggggccagaggtgctgtaaagatacaggaagcactctgaactggcaagttagaaacttatcaccaagtatgtttatcagccgagtaagaaacctgaccagctacagttacagcagtagaagtggactaggagcttaggggacgccagcagtgctgacacaacaccaggaagaagtgtctcacataatcttcaagaagaaaacataacattatctagaccacatcctgggcaggcagaacagccggcagtagccctcccagagcagaaccatggcaattcctcctaccccaagcccacgaggctcagtcaaggttcagtcacttgttcaacccagcagcaggtgcagtgtgtatggataccaccagagcccagcaagtctttacatgctttctccaaggcttcttttcagctgacagagaggcaaagaacctaaggttacactatctgtcaaatactcagaatgaaactgctctgtgctgctaactaaatacaggatcaaatactaaccagctattaacactcacggtagagaaacagggatctggccacgtctgtccctgactccagcatctggaactgtgattctcagtgccatcagactggtattcctttgcattctttgatatttcatggagtctcattgctatcccaatattaagttgataattaattctgttccacatatgaataatcttttatgtacacatttcaaaataaagaaaccagtgtaataccctaactaaaatatgaatataacaccctggctaaaatatgcagcaaaagaaactgataatatgatcatttgtatttcagcattaacaatgttttcctgtgctgtagcagccgccatcaaagagcaacagccatggccctgagttaccccgtggctgcgggctcaacaaaagtcacaaggtgatcgacaacatcaggaccatcagtacaaatataaggtgacaaaaaatcatcagcaagcccaggctcaggtggggagggggagaggaggggtcaccaatgacaacaagttcgtgtgggacacgacccaggaggatgtgtggctttgtgccctacgagcagcatgccacgcagctgctcaaggtgtccaaggacaagggcatgcccaggttcatcagaagagggtggactcgcacaggtgcactaaaaggaagtgggaggcactgagcaacgagacggtggccacgaggaagaccagggtcaagaaggatcggtacccgtgccacaccctccccaatagatgtttatgctgaagacagacaaacaacaacaaacaaaacacaatgtttcctatgtacccagtggtaagacttgcgtaattcctagatttgaagatttgtgtaattcctagatttgaagatttgtgtaattcctagatttgaagggaaattagaatttttttttcaagacagggtttctctgtggagctttggagcctatcctggcactcgctctggagaccaggctggcctcgaactcacagagatccgcctgcttctgcctcccgagcactaggattaaaggcgtgcgccaccaaagccctgctcgaaattaagattttattccacacgagaaacataataatatgcaaagaagtaaaaatgcttcctataaaaactatgcctagtattaaatctactatcagattatttgtatagagaaaatctgtgaactacagtaaggcttttttatatgcaccccccccccccgaaaaaaacctgccacattgaacagaatgagaagcaatgacattcctaatggcaaaaacaagggtgtctgagtgaccccttgtgccttgatgtggaataataacattagtagaactgcattcaaacttggtagtggctctataggaccagctcctgggttttcaggactattctgcaccctgacaaacacccctggtacctcatctctagatgacatcagtcctgcccactcctcatgccaacaaacatactttcctgcttttgaagcatccccataaagatccaccagtccagcccagaggagcagttatccaaagcttgaatgagcaaagtaggaggcaaactgaatcagtccctgaagatccagggaccctgactctgctgaggtcgctgggctactctgcccccaggcagtgcagagtgcagagtgcagaatgcagaaagtacagaggtgagctgcttcggcccctgccttgggcccaacttccacctgcccactctgggaaatcccaccctggggtctacaggcaaagtgaatcagtccctgaggacccaggaacccagactctgatgagattgctgggctattcggcccccaggcagtgcagagtgcagagtgcagaatgcagaaagtacagaggtgagctgctttggcccctgacttgggcacaactttcacctgcccacactgggaactcctgcccaggggtctgcaggcaagtagactcggcccctgaggaccaagcaacccagagtctgctgacatctctgtgccaggcctgctcttgcccacctggagagcgagcctcggacctgcctgcacccaccttgagacccatcagagtattgaagccaattgcaaccacctgaagagaaccccagacccatacacaccaggaaaggaagtgacaccacctgcacccattggaagaagagatgggaagaccacaatataagaacacatccaacaacagggaaaccaatatgacaccaccagagtctagggactctacaccagcaagacatgaacatcccaacacagaggaagcagaagagagtaaccttaaaaacaacttcatgcagatgatagagatcctaggagaggaaatcagaaaatccttcagagaaatggaagaaaagacgaacaaaagatgtaagaaatcaaggaaagccaagaaagccaagaaaatacaatcaaacagatgaaggagacagttcaggacctgaaaactgaaatagagacaataaagaaaacacaaactgatggaatgctggaagtagaaaagctgagtaaacaatcaggaaccgcagatgcaagcataagcaacagaatacaagagatggaaaacagaatctcagacactgaagatacactagaggaaataaattcatcaagcaaagaaactcttaaggccaacaaatctttaacaaaaaatatccaggaaatatgggacactgtgaaaagaccaaacctaaggatactaggtatagaagaaggtgaagaaacccaactcaaaggtgcagaaaacaacaaaatcataaaagaaaactttcccaacctaaagaaaaaaatgccaatgaaagtacaagaagcatacagaacgccaaatagagtgggccacaaaagaaagtccccttgtcacttaataattaaaacaccaaacgtacagaataaagaaagaatattaagagcagcaaaggaaaaaggccaagtaacacataaaggcaaacctatcagaattacaccagacttctccatgaaaactctgaaagccagaaggaccagaatagatattctaccaactctgagaaaacacggatgccagcccagactactatacccagcaaagctttcaatcatcataaatggagaaaataagatattccacaacaaaaccagatttaaacaatatgtaaccactaattcagccctacagaaagtactggaaggaaaactccaacctaaggaaattaactacactcacaaaaacataggcaatagataatcccactttacgaaaacccaaaagaaaaaaacagggtaaatccacaatacaataccactaccaacaacaaattaaaaacaaacaagaataaacattcaatggtcacactcagccaggcaatggtggcgaacacctttaatcccagcacttgggaggcagaggcaggtggatctctgtgagttcgagtccagcctggtctccagagcgagtgccagcatacgtttcaaagctacacagagaaagcctgtctcaaaaaacaaaacaacaaaacaacaacaacaacaaaaagaataaacactcaatggaccttaatttcccccaatattaatggtcttaacttgcctataaaaagacacaggctaacagattggatatgaagacagaatccatccttctgctgcatacaagaaacacacctcaaattcaaagacagacattacctcagagtaaagggttggtataagatattccaatcaaatggacccaagaaacgaactggggtagctatcctagtatctaacatgttagacttcaaactaaaatcaatcaaaagagatgaagaaggtcatttcatattcatcacaggaaaaatccatcaggaagaagtctcaattctaaacatctatgctccaaatacaaaggcaacaacattcgtaattgaaacattattaaaactcaaatcacaaataaagcctcacacagatatagtgggagacttcaacaccccactctcaccactggacaggaccaccagacagaaacttaacaaagagacaaaggaactaacagaannnnnnnnnnnnnnnnnnnnnnnnnnnnnnnnnnnnnnnnnnnnnnnnnttcttttcagcatcacatggaaccttctcaaaaatcgaccacatagcaaacctcagcaggtacaaaagagttggaataatcccgtgtcttatcagaccaccacgctttaaagttagaattcaaaaacaacacaaattgcagaaaacctacaaactcatggaaattgaacaacaggaaattgcaccattcatgggtcaaggaagaaataaagaaattaaagacttgctagaattcaatgaaactgtagacacaacatacccacacttacgggacactttgaaagcagtactaagaggaaagttcatagctctaagtgctcacacgaaaaagctagagaatagccacaccagagagctgacatcacagctgaaagctgtagaaaaaaatggaagcatattcaccacagaggagcagacaccaggaaaaaatcaaaccgagggcagaaatcaataaagttgaaaaaaagaaaacacttcaaagaatcaatataacaaagagttggttcttcaaaaaatcaactagatagactatccaaactaaccaaaggcagagagagaacatgcaaattaacaaaatcagaaatggaaagggaacataacaatagacactgaggaaatccagagaatcttcaagttatactttgaaaacctgtactccacaaaatttgaaaatttaaaggaaatggacaactttgtggacagttatcagttaccataattgagctacaattacattggtactcaagacacaactaagaaagagaactacagaccaatatccctcatgaacatagatgcaaaaatactcaataaaatactggcaaactaaatccaagaccataccagaaaaatcatccactatgatcaagtaggcttcatccctgggttggttcaacattccaaaatctatcaatgtaatccaccatataaaccaactgaagaagaaaaaccacatgatcatctcactagatgctgaaaaagcctttgacaaaatccaacatcccttcatgataaaggtcctggaaagatcaggaataacaggaacacacctgaacaatatatatagtaagccaacagccaacatcaaactaaatggagagaaactcaaagtgtttcctctaaaatctggaacaggacaaggctgtctactctccccatatctcttcaatttgtccgtgaagttctggctagagcaataaggcaacaaaaggagattaaggggatacaaattggaatggaagaagtcaagctttcactgtttgcagatgatatgatagtttacataagtgacctgaaaaactctaccagggacctcctacagctaataaacaccttcagcaaagtgtcaggatacaagattaactcaaaaaaaaaaatcagaagccctacaatatacagatgataaatgtgctgagaaagaaatcagagaaacatcacccattacaattgccacaaacaacataaaataccttggggtaacactaacctaaaaagtgaaagatctgtatcataagaattttgagtcattaaagaagataccagaaaatggaaggatcttccatgttcttggataggtaggatcaacatagtaaaaatggcaatcttgccaaaagcaatctacagattcaatgcaattaacatcaaaatcccaacacaattcttcacagaacttgaaaaaacaattctcaactttatatggaaaaaccaaagacccaggataggcaaaacaaccctgtacaataaaagaattttcggaggcaacaccaacatccctgatttcaagctctattatagagctatagtcctgaaaacagcttggttttggcacaaaaatagacaggtagatcaatggaatcaaattgaaaaccctgacattaacccatacacctgatttttgacaaaaaagccaaagctatacaatggaataaagaaagcatcttcaacaaatggtgctggcatagctggatgctggcctatagacgactgcaggtagaaccaagtctatcgctatgcacaaaacttaagcccaaatggatcaaagacctcaacataaacccagccacactgaacttattagaagagaaagtaggaaatacccttgaacggtacaggagaccgcttcctgaacctaacaccagtagcacagacactgagatccacaactaataaatgggacctcctgaaactgagaagcttctgtaaggcagaggacacagtcaacaagacaaaatgacagcccacggattgggaaaaaatactcaccaaccccctatccgacagagagctgatctccaaaatatacaagaactcaagaagctagtctcgaaaacaccaaataatccaattaaaaagtggggtacagaactaaatagagaattctcaacacaggaatctaaaatggctgaaagacacataagaaagtgttcaacatccttagccaacagggaaatgcaaatcaaaacaactctgagataccatcttacacctctcagaatggctaaaatcaaaaataccaatggccgtttatgctggagaggatgtggagaaaggggaacactcctcccctgctggtgagagtaccaactcatacagccactttggaaatctgtatggcgattcctcaggaaaatgggaatcagtctaccacaagatccagcaattccactcctaggcatatacccaaaagaagcacattcatacaacaaggacatctgttcaactatgttcatagcagcattatttgtaacagccagaacctggaagcaacctagatgcccctcaactgaagaatggatagaaaaatatgtggtacatttacacaatggagtacttacttgttggaaaaaaaggcaatggggacttgaaattcacaggcaaatggatggaactagaataaaccattctgattgaggtaacccagtcacaaaaagacaggcattgtatgtactcactcatatgtggatttttgacatagaggaaaggattgtcagcctgcagcccaggctgccagagaggcggggaaacaaggaggaccctaacagagacatacagggtcccccaggaaagggggaagggacaagatctcctgagcaagttgggagtatgggaggaggggagagggaactaggagaatgagaaggggagaagaggagaggtgaggaagacataatgggacagggaggttgagttgggggaagaacagaagagagcaagataagagataatataaatagagggagacattataggtttaaagcgaaatcaggtactagggaaatgtcaggagagctacaaagatgacaccaactaacaatttaagcaacagaggagaggctaccttaaatgccttctcctgataatgaaattgatgactaattcatatgccttcgtatagcctttaaccagcagctggtggaagtagaagcagacacccacagctaaaccttgaactgaactgaaatccagatgcagagaaggaggactgatgagcaaaggggtccataccaggctggtgaaacccacagaaacagctgacctgaacaaggggaaactcttggtccccagactgatagctgggaaaccagcatggaactgatccagaccccctgaatgtgggtgtcagtgaggagaccttggaaatctatgggacctcttgtagtggctcagtacttattgctaccatagaaatggactttaggagcccatcctacatggagggatactccctgagcctagacacaagggggttggcctagggcctatcccaaagaatatgacagactttgaagacactcccatggaaggccttacccttcctggagagcagaaaggatatggttataggatgaatagggcattagttgggggaaggcggggaaggaggggagggagaggaacctgggattgacatgtaaaataattttctttcaaataaaaaaaataataaaaaatgttaaaaaataaaaaaaaatgagcaaagtagcaaatgcttaactgaggaaggaaagaatgaacaaagccaactttggaaggaagaaactaggacatggggatacacccccccccaaaaaaaaaaggctgagatgaagctctgaagatctggaccacaaggacctggtttaggattagcaaatgggtaaatgggtaaattagcaaatgggtaaatttgcaaatgggtaaatttgagtaagaggcaaacaaaatggtgtactgtacatgaacctaggggtgtattgtaccccacaaccctatatcttgcctctacaccccttatttcctgctatgctttaatgtgcacttcaacagactggctagcaagccctgcattttccaggttcccaacatggagcaggggcaggcatacctccttcagtttctacagctccagaaggcatggttggtctctcttctgtcttcgattcttgttcaagagcctacaagataaaggggggaagggtggtaaatcactgaaaactattttgggcccgatatgcaaaagaggtaaaaatcaccatcacagagctgggaaagctgtcaaggacagtatgtattaggcgaagaggtaaactctgatagaggaacacacagccagtatccaaggatgatgacaagaaaagtcggatgaaacccaggggcaagggtaaaaaccctgtcacaaattctcactttttctgctgttcataaccccaagtttctcaggcatgctgtgtatgaaccacagaaaggaccttgacacaaaaagggagaactgagtgttgctacacctaccctactggagtgtcctatacccacatcctacacaggtgatgaaaagaggagctgatgaggaggtaggaccacagtcagggtatatccagagtgaccaccagtcaaaaagtatgcaggctggcacagattgttcctggctggatccaagttgcagagccatctcaaggtcagggcaaaaagatgccctcttgtgatcataattgcttttgagattctcttggcccatgaaaatatgaagaaacataaaattacattaatgaactgaacagttaagcagcccaagatggtgtcaataggttctacaataaatcttcagcctcattgggtggaaaaagtatacaactaacatagttggtgaatcctaccacacaattaagctggtagattgagtgagtgcctcattcactcagaacatcctaagatcaggatatgtatccaaagtaccaaactacaaaggggaagtgggcaataagggttaaggcatacatggtgggctacctctgccatgtcccctataagaagtgcttttctctcttttgggccccatgagattaggaaaggactagaccacatctacaatggatgctaccaaggaagtatgatctagttagcttttattgtcaacttgatacagcctggagtcacctgggaagaggggatctcagttgaataattctcttgatcagttggcctatggacatgtatacaagagactatcttgattgatgattgataattgatgactgataattgatgtagaacggccaagcccactgtaggcagtaccatccctgggcaggttagatggacatcagtcaagagcattcgctgctcttccagatgacctgggttcaattcccagcacctgtatggtggcttacaaccacctgtaactcccacttccaaggatctgatcatattttctgacctctgcaggtatcaggaatgcacatagtatacatacacaggcaaaacactcatacacataaagaaccctaataatcttttttaaaaagtattttttggcacacgcctttaatcccagcactcgggaagcagaggcaggtggatctctgtgaattcgagaccagcctggtctacaagagctagttccaggacagcctccaaagccaaagggaaaccctgtctcgaaaaacaaaaaaaataaaaataaataaaaataaaaataaaaaaacaagaaagaaagaaagaaagaaagaaagaaagaaagatagatagatagatagatagatagatagatagatagatagaaagcggagtgtgagtcagtaagcagcattcctcatggttactgcctccaggcttctgccttgagttcttatcctaacattccctaatgatagactgacatggaagtgttagccaaataaaccccttcttcccacgttgatttggggagcagtgtttatcagagcatcagagaacaaactggagcaggtggcacctagtataaggagtgatgcttggaagaggagtcttcatacaagctcaaggcctgagttaaccatctgtccactgtttacccagggacaaccttgaccttgaacccatcttccattaaagggagttgccaagcctgtgtgagaagagggcatcagacaacactagtttctgattacaaaactaaatgtgaaataaaacacctaactttttcatgtaaatgagaggcataaaaaatttttattcttatggccgttttggaatacatctttaaacacttaaatttcccagttgacatattcattataggtcagtgctaggaccacatttatcagcacactgactaacacaaacaggctttgttaaaaagagatcatttaaaaaacattagaaggtacaggcaagctctcacctatcacaggtcaggctgcatatgtggaaggctctgagttcaatccccaacacaacacaataaaataaaacaaaaatatatacttagctatatttagaattctatacacatatgtagcatgagactgtatttttcaattctttaaatccttcactaagtttatttatttacttattttgtgtattgtgtaattatgtgtgtcgcatgcatgtgctgatgtgtgtgtgtagcagaggacaactcacaggagttgatgttttccttccactgtgtgtgtcccaggaaattaaactcaggtcatcaggtttggctgcaagtgctattaccttccaagctacttcgtcgtcccaaatttcttaacatttgccactacagtttggatagttagcaacagtttgacttttagtactgtggtggtttgaaggagaatggccccataggctcatatgtttgaatgcttggtccctagtagtggaactgtttgggaaaggattaggaggtgtggccttgttggagtgtcatacctatgccaggcccaatctgtctctgtgctctgtatctgggtctctctgtatctgtgattctctctgtgtctctctctgtctcctgcttatggatcagatgtaagttcttagctaatgttcccaagccatgctctccaccatgatggtcatggactcaccctcagaaactgtaagcaagcccacaattaaatgctttcttttataagctgccttgttcatggtgtctcgtcacagtaacagaacaatgagtaagacaagtatttattacaaattgtcaaggcattatcatcatcaactacaagacagagtggaaaacataaacattaacagctctgaccaagcgtggcttttgaaagtgatgagaagcagagttctggtgcatgagaaggcaagcaaggacttgtcaaggtcttatgattaagttctacagagctgtaggtaacaacaacattcccagaccacttaaaatgagcatgtctccttgaagggacggagtatggctgtggccccatgtacacagagcagccactcagatcatgatcatacagaaaaaaaaaaaaaaaaaaaaaaaaaaaaaaaaaacgagatttcagtacatatcagattcaataaagcttgaattatttttcttttccctcccctctcctttctcttttccttcttgtgttttgaaacaggtctcaatatgtagcccacactggcctaaaacttgtaatcttcctgtcttagcccccagagtactggaattatagaaatatgaatgttatgtatgtcaccactcctgggttagcatgaatatactgtatgaatactccatatgtattctcattaatatttattgttcacaattgtcaaagtgtagtatagacatgccaaataagaattgcctttgggggctagagaaataactcattgtttaagagccctttctgctattgcagataattactgttcagttcccagacaccacatggcaattcacaaccaccactaagtctagttccagggaatccaacatcctcttctgattccatgggcaccaggaacacacaggtgcacacacatacatgcaagcaaaacatgcatacacataaagtaaaaataaatggttgataaaaataatctgccttttgtttatacttacagtaacatctaaccatgtaagatatagcatgaccaattataaatttaagaacgtacagaagcatttgtcatggcagttggcgtgattggctttggatggcaagaggaatgctgaccttctccctaccttcccagacttcttgtttacttcccaagcaatgggattacaggagcaagccaccacacctagttcttaactggttctcttatttttttcatgaaacgaaacctcagaaacttgtcattcaactctcctgccattgttattgtagagcccactacaataaaatgatgtggcatctcattttattaatcccatacctttctcaaagtcagtttctcaaatgtgtgaaatatcaacaaatccagctgaaggattctgtaatgatacaaattcccagtgtgttggctgcacacagaacatgtcctgttctttctacttgagtcaccacatgctgcactgctctctgaacagcactcgcagggccatgcatgttgccaggctctatccctatggggcttctggggccagactcctcttgagaatattgtgcagcgtagcccagcatctcctggcagggactcatcaccattcggtacttcagtgagaagccacaggaatggtttagtatcattaaatgacaagtgcttgaagctcagccctcgcttgtatatactaaattgaattgtacatttcagaaaatgacacataaaatttcctaaaacccaatggggggggtcagactctgaagaacatatttcattttaattatgccaataaaattctacatgggatatgacaataatatttatttgctatgtaaatattttaactgcatttgtagtttaattatataacataaacacagaagccaaactatgatggtttctgtttctctcggttaatgttttaatctggttgaaaacctgttcagctgaggaaaaccatcttagaagtagatgtgcttgacacatgggaaaccacttgatctagacagggactctgagggcccctgagcactgtccactagactgaaccagattgtattcaaaacaagtttgcttactaaaagtgaaaaatttaagtattctttatatttgaccagaggccctcaaatccggtgtcattgccatgataggaaggagtaaatctctttataaaaggactctgttctcacctgtcctgttttaaatacaaacaggacagaagaaatcatcgaagtcataagatgctgtaaactgttttagataagaattagagccagacgttggtggcgcatgcctttaatccagcactcaggaggcagaggcaggcggatctctgtgagttcgaggccagcctggtctccagagtgactgccaggagaggctccaaagctacacagagaagccctgtctcggaaaaacctaaatcaatcaatcaatcaatcaataaataaataaataaataaataagaactgccaatgagtacaaagaaaacatatcatattagaatattagaattcagttgtgggagcctggtatggaggcacacatttgcagttcaagtacaaagatgtaaagatcccaagtgcaaggatagcttgggctacacagcaagaccctgtcttagaaaacaaaaccaacaacaaaagaaatgcaagcaaaacaacaatggactgctacttccatgccacctaaagctgtgctggcctccattccacttatccacaggagctctgacttcacatcatcaagttttcattaggaaaaaaaaatgttagctaccaagcaccattccaaaccagtacacagatcccacacacactaaggagcatgcaccatcgagcgagtactgcagtacaaaccttgacaagaaaggtcctgtcccaaaagtacttcctgaagagtttgatatctgcctccaacaaatgctcagcagtgtgattaacagtcagagtcaatgtttctgatgagtgaacgaactgcagacaggcatcttcgttgagatacagtcgggagaagcctggagaacggctaccctgaaaactgaaccgtcacaagtcaatccacgcagcttcacagatgctatcccgcatcctgcccagagattaaaaatccaaatggaaaatgatccttaaaagtcacttacacacccaattacacaatcgtgtgtaaacagatgcgggtcaagccatctttgtttttccactgagtggtggtttttaaaaccctatacatttttaaggttcctataaataacaaaacagtcctgatttttaagcatagaaatgtacctcactatttccctctccttttagtcagaaaagatatttctccctttaatggagctcatgtagaacaaattagctggcaaccaatagtttgttaggtgattataatggaaaacagataggatctccagggagtatggggaggtttgaatgtgacaaacaactgttaagattcctaacacactggtaccactgtattaaatcacttcctcatgcaaattagagcatgcataaatctgattaggtcatagtcttgaacacgttcattaacaatgaaacaatatacccaaactaaattcttgaatataaccttattttctcatctgtcttggctggctaagaacaactgtgttgttagttatacagctgttagttatacagcttcttgatggctgaaattacagcactaaatcagcatagcttataagatcatgtaatagtaacagtaaatatgcatcaggtgaaaaatattgatgttcatcatgtggtcacatgccaacagactgtccccagatccctggctttacagaaccagctctgcccctttcttcttctggcatgatctcattttgttaatgtttgctttacagaaataaaagagcctgtaacttatgatggcttgatttctaacttgtcaatgctacaatgctgtaggagatatgtgaattcactagaaatattactttctggtcttgaattttgattttacccagactggaggatgatacatacatagtgtattactctctccagctgttggacagtggaaaaaagcctcatcccacagtcacccatacagccataaggctacaaatctgatctcccacagtggaccatgttgcccagtgttgtatagaaggctaagtacaataaatgtattggcaacttgggctattttcaacctaagataggttcacaggacatacctccttttaaaattgaggagtctgaggtgacttatctcctcagatggagtgacaaaaagagatctataaagagcagctctactagaaaacacagtcttcacactgactccagaatcttctataaagcaagcccttatgccaacaagccattgaaaagaaaggatcataagcctgagcaatagtagagctgttgttaatttagaacacggacactccgtcaatgatcatatgatcacataatcttgtagccagaattgagtctacttttaattccacctatgagtggatctgttaaacacataaacttttaaaacataccgtatcttctggtgctagaaacaggaataaggtacaaagcacccagcagataaaggagtctacctccaggagggaacactgcaccagccaccataactcagttaaaggacatgttcttggctcagtctttgtagccaagaaaatagggttgtgttcataaccaaaggaaaggacaattccctttggagaggtttgtcccttggttaatgactgtttgatcaaataaggcaggggatgagaaagagaaagttctggtttctgcctaatggctacttaggcatcaaattaccattaattaattgcatcaaattaattacattgagttatatgacccaaacaagaaaaaacatcccactaagacacaccatgtaataatactccaacaatatttaaaatatttgttgtaattttcaatgtactgttcaatttataatttgtattttaccatgtcatatcaaggcaattactatatatggctccttccttcataagttagaacaataattcatctgaaccaaaataatccactggtcactcactagaggtaatgagaacattaccgacacagacaacttcatagttaccagattatgtctcttgcagtagctcaataaattctagtgactactcctataggggttgcctgttagtcttacagtgaaaattatggcataggcattggactagaaatagtccaataagtagaccagaaatgttcccatctctcacatgattcagaagatagccaaaaaagtaaatggtcatgtctgtataattataaattgtggttattactaaaattaatcataatcataaaagaatataacttggaagcctttgctgaggaaatgatgttaaagctgaagcctgaaagatagtgtagcccactgcttggcaatccttttttcattatcttccctgtgtctcccttacaaaatactcccaacaaaggtatccacttatgctagctaagcatatacttgtactacatgcaagaaggctagctgaaaaaaaaataagtcaacattagcagatggcttagttattctcattctcccataatgcttgtcaggctttatagacatggttaagaaaggcgctatcaagcaattgaactcactttgtgatgtcttccaccagtgtggagtgtccaccttgcaaagctaagtctaacggtgtcgtgccctcttcattaggtagctccaaggccttgactcccccagggagacacaagagaaagtggaaaagcttaggcaggccccatctcacagccaggtgcagaagagactctctgtgtagagatactgaagaaaagggaaaacgtaatgttagttcctccattcataaactttgttttgtatattttattatatactggatataacagaagcctcagggctggaaggaatcaaaagcacctcatcttgacctcatgctctatgaatgatgagaggtcctgggatatttctggaggtcagggagccaaagggtaccggtgctatgatactcatgactggtactggctctttccatccactacactacatcctgctgccacctaggatgcaggaaggaacatcaccagaggatacagattctcaggaaagatcattctttagaaacacactcatcagcttccaaggtatccactaagaagatcctgccacacaggcaaggcaggctatcaagaccacaggcacaaagaaacctctgtttccaccattcatcctcagagcctgtccttcatgagaggctgtgacagaaagcagttccttaagtgcagagcacttgtgaccacagtctgtccccaacctcacagtgctgtgtgtgcccagcaattagatccctgggaacatctccacactgccagaggcaccctggtgctatgcctttgcagatggccctgaacaggggtccttggcagcctcatgctagtttccactgtggtgtttactgttgtgcgttatgctcatttcctgactttcactgtatgggctgccaggcccttgaagattttccttcttaacagtagctagtaatgcataaagccattaaaatacttgcagagcttaaaaataattagctattaaagtctcaattgtgtgtgtatatttacttcatctgtaatttgtagagagtttgtacttgtctctctactgtaatagcccagtacctaagacacaggtgattcatgacacaaactgtattgcaaatatgcaaaatataaaaacattttcttacattataaaagctagacccagactggctgtgggggcactttcctggaaacccagcactcaggactgtgaggcaggaggatcacttatgtccagaagtttgacactaatctgggcaacacagcaagatacagactacatacatacatacatacatacatacatacatacatacatacatacatacagggctcctaaactttatatgcatggtcacactttaaagacaccttctcctaacagcctaaattcgaagagctgatcactacagctctgtggcgataagcagagcagcacacagtaggggtctagtaagtaataacactgaccatatccataacccaagagagctagacaatgaatgaaagacccaacagggtagggaccttgtcttctgccctgtgggatcctccaagcatcacagcacctgacacacttgctaagcatttacagattacaggaaattacacacaaatagcaaacccctgtggaagctggcgtttcatctttgactgtgctactgtacacaacacccatcactctctgttttgtctcggataggtcttaaatgaagtctcacaacagacactgtggactcccacttggtactcccacatacaactagggcattaaggacaaaaatgccagcttcccacacagctcactgtccacaaaaccatgatcttattgttccactgtcttcattaacataacttcactattgccagactcttgcccaggcaaatcagtgactgtttactgcagaaatttcccagcagactcatcaacctctcggcaggaatcaccaatggagagtgcagagaagccctaaatacaattttaagctatcatgatccttgccaactcctaaggaggtccccatctaaacctgccattccccctcactatgactaaccctactaccacaatgaaaaatctttattaaaccaagcttcaatttcttagtgaatttctgtcttgccatccccagtccctgaagccactaaaggtttgtaacagtgtcacctgacttaatatgacagccacaggcacagctttgttatatgagggtaaggaatatttgtggagggagcatggaacaaaatcccaacacaacagaaataaataccccactgtgcatggatacaaaataaaactgcttcttttacattttcacagatctatccagatttctcaaaatccacatcaaagactacagggctttagatttcaaatacattaggaccgataccagagtccttatcacagtaaagtaccatcgagtgccctgtatgctctatcatttgtcatgtgacatatagcacatacccctctatagtgaaacagcagcccaaataccaaaacatctgaaaacagacccacagccctggctgcatgcagttaccatgcatccgtttaatatgcttcaactcatctctatgaaaaccacaagactcgtgttggcttttcctctccaggtgctggaaactcaacccaatgcctcatggacactaggcaggaaaggtctttcttgtatccttgaagttattaccattgcacttatttaaacatcatggctatcattcttagcaggttccctgcaggacaagtctgacaacatttgtacttatttttcctattttaaataataaccaggaagagacttgttaggatcagataacaaaacaagcacacacctgcacatgcatgcacacatacactgaccagcagaggagggccgatcatcatgagatactgagcagccagccacactaaatggaatttttacaccacagatcccttctgaatatggtgagaaatgtcccatgtttgcacaggtcgaaatttcttccaagaaaaatacaactgagaaacaaacaatatctgtctaaagcagtggagttcaaacagtagcatttggtaaaggcaagcatggtttcagtatgtgaacagtattccttagtgtctgctgcaatgttctaaaactgggtactgttgactatattcagctgactaagaagagtgagtgtggggccttgtttcctccagtagcagaaacttccaggcctgtctggctagtcccaggcatctactgtgttttatgaggggcagagggggtccatcctcacatatcaaatgaaagagaactgtaacaatcatgcagctcactggtcctttcccctagcctcagaagtccttcttctggaagaggaaggaggatggaaggcagggaaagaaggctcttctgatggtcaaagaaagcacggaataaaattaccagtgttaaagagagagtactctcattcagtataaagtccagcatggagaagaaggcaaacagcttgaaataggaagcatcgtgacatatataaataattctgcttgttagaaggttcagatttcttaacagcagccaaaaaaaaaaaaaaaaaaaaaaaaaaaaaaaaaaaaaaaaaaatgaaatgtgagaagacactaaaatggggaaaggggttatacagtttggcagaggtagggctatttaattaaaatgaaaaaaaaaaaagaaccaaataaatgcctcttcctgttggtttagctagtagcaggagttgtctgaagttactgaaacagaattactaataattgctctgatggcacacattaaaaggtctgacttctaacatcctgggaacacaatcatcccgacagagagaaactgaacaggctgtgactttcaattaaccactcctgttttggaacggggagggcctatctgcccttaacagggaacaaagcttgattcttacatacttcactctgtgcagcatcagtttcttttcttataaaatgagtctgacatacacaaaaaaggagccagtaaatcccggctcattgccatgaccaaatatccgacaagaagcaactcatgggaggaaaggttgattttggcgcgtggtttgagaaggcacagtccttctttgacaggagagtgaaatggttgctcacacagtgttcacagtcaggaatcagaaggaggccaccgatgctcagttggctctccctttccccagcccataagaaggaagagacctgcattcagggcaggtcttgtctccttggttaatcctctttggacacacccaaagacttgccttactaatgcccagtgtttcttaacccaatggagttgataattgaaatgaaacaccctaagtccactccttctcaacttgatacccaaacaagtcacttttaaacacaaacattccaactgcccttaaaggttcatggccatcttataatttaaaatatttttaatccatcttttaagtttaccagttccaccattgttcaaaagaccaaagtccaaaatctcacctgaaactcgaaaatctcttaactgtgagcctgaaataaaccctctaaaatattttttaagttaaatattttcagtatacagtggtacagaagtaaaaatccccattccaaaatggaggaatgggggcatagtaaagaaatatcagatggaagtaagatgggaacccagtaaagcaaatgccacaacctgcaggctcctgcccagcatctgggacttataacaccataggaactccaacaggtttacatagccctgctcctccagatctgttcctagggcacatgtggcctttctttaagacttctgtactttcttttatactgcagctttacactgtagatgtccaatattttttgcatgcccaatatcctgagaactccattgcaaatttggctcctctttctcagctttacacacccttgcaggtaacctgcaccaccacaccatgcctggctttagatgtattctggaaccttggcaaaagcctacatgacaccctcactctcaacattgtgctaggagcttaagatgtagcctggccctcctgcccaaagttgcctcagcttctaaggggctgatctctgtgtgtcttaaaagtcaatcccaggaatatatttgcataggcaatcctggactttcttccctattgtcctggaggcatctttcctatcattccagtacaaagtccagggcttctcattaatggtgctaatctctaacatcaaagccactttgtcccaaccaagctcctttcctcctcaacaaactgtacatttttcatctttctgcatgttctctttcattctctctccctcccccacctctctctcattttaaatcttggcaaatgtgagtagtaaccatgtcacatcctgaatgttacgccgtcttccaccaaaaaatgcagttcactgttttttaactcagcctcactcaaattttcaggacatgggtaagacagggctttcaatttagtcattaatcctctctggaaatgccctcataggcacactcaaagttgtgcctcattaactcctgagatgatttttaatctactcgagttgacaatcagaattaactgtcacagttccaaagagaagtcagtccagtcctgactttatagtgagcaagatgtacaaaaaacagcatatactgaggggacttacagatcatctaaggcaaaagagaaagaacagaagatgttttaagaaagtggttttactttgcagtcagtctgcatgtggaaccagtagtataactatacatacctttcaattagcataatattcagcatggaagatttaaaacttaaattgccaatgtaggctcatcaattataacaactgtggagagtagaagaagttacaaatgtgtaaaaataaaaggcatttagaaaattgctgggctggtgagatggctcggtggctagcagcatttgctgacaagcccaaggatctgagtttgattccctagggcatacatggtggaaggagagcatctacccctctgatgtccacacatgtactgtggcatatgcatgcattgacacacaagtaaataataaaagataaaaataactaactaaataaggttccctaaaagtaaaattcaaggattttcctatgagatgcctctatatccatgtttattgacacactactcacaataatcaagatacagaatcagtctaggtgcccattaacaaatgaatagaaaaagaaactgtcataagtacacacacacacacacacacacacacacacacacacacacactgatacccctaatattcaagtaccagcaacctagaacactcgtattatgattagagatacatatctagaagattcaatcttgaagaagtcagatgcattctccaaagccagagaactatgaattgaatcagttttcaagaagactagaaacactaattaaaggcgtataatatatattacttgattttaatatagttgcattttattaataatatttcagtatcattcatttgtacatactttgttggtctttgtagaaggctttttatatggccaaaagaagaattaaatcatgttctttgaagtaaatgggcaggacaagaaatcttcatgttaacagaaataagcaagtctcacacagacaattattgttttctcacatatgtggaatgtatgggaacatgttaaaaggacatgaaaataaaagagggactattaggatgtggaaatgaattggggtgaaggggaaggagggctaagaaaggaaatgaggagataaatatagtcaatacttctgaaaatagccaatgctgggccatggtggcacatgtccttaatctcagcactagggaagtagaggaaggcatctctctgtgactttgaggccagcctggaatgagttccagggcagccagggctacacagagaaaccctgttttgaaaaaccagatagaaagaaagaaagaaagaaagaaagaaagaaagaaagaaagaaagcgagcataaaaaatgtctgaacactcaagaaggccctccccagaacaaataaataaggatatctgaagggagatgagcacccatgtttcctagagactctaacactaacccagagttagggttctgcctcttaaagccagtaattgttaggcaaaatacatccctaaggtttgccttctagagcactgttttcccaatctgccctgaagaactgtcatcttctaaaaagaatattaccaaaggacaaaaactggctacagttttctgtgagtttaacaagttctttgccacccaaggcgctaactgctaagccaggaaataggcttaaactcttagcaaaatattataattaatacacaatggggatgaaaatctagaagtaaatgatattttcaaaacactaataaattcagaagctagagttcagaatgtgctataactcctgagggaagccataggaatatattcagcataataaggttttgaagaccaatgggctttcattcacataaatctaattcattaaaacaagttctattcttatttccaatactgcacaattgtacaggtctcaacttgtgctcccaagtcattcagcaaacaaatattaaataatcgaatttctatgtgccaaacccaagtgtagatgaacatagttcctcctggtgaacagcaaacagccatttgtgttcagaataaaataaaaggctgacctatagaattgttgtctagtaaactagaattctaaggcttagacataaagagtgtatgaggaaataagaagactattcagctgacaaggaaatgtatctacatgtccaacatacgaggtatcatgacacagaagtttacagatgtttataaagtgccaactatggagagcaaaatttgaggaaactattaaccaacatttacatagaaagtaaaaagaagatttggcatggacatacacaggctctgagatatttgcaaggttgtcagtgaaagtaagaaaaggggccaggttgtacagcattttctgcccatgcagtctgttcagggctccggtagcgggtatacagccagccttcagtaccaaagatgggaggctggtgaatctaaagtagaaatcacaactataaatatgcttatttgaaaaaaaagatacagagcatcaaaaagaacagatgaccaacatggcagccataggctgatcataaggccagaaagaaggcatggagaggcattagcacagtggcaggccatgcttgcctcaagctgcttttctgtacctaatgcattcacattgcaaccacgcctaataatctctggaaacatccatcacatgccatcattcctgaaaatctacattgtctgtttacaacttagatgggtttggcatctcactgaggatggctgtattttggcttctggaactataactaaatagttgaaacactaaaaagtctattagagctccaagatgaaaacctcattttggctttcacatctagatacattccaaacagaaacacacaatgtgggcaatagtatcaggttgtaagaacccagacacaccttcaatagtgtaaagggggatggatgaaaggggtcagggcctggagttgagcatttacagagttccaactctggggaaattgccttgtctgtaaaagggaaaataatatcaagccagcttactatctcaaaatatcagaaataacatataggtcagggttcccaagaactacacatgatcttttttaatacgagaaatcacagtgtactgtcactaaatagatatgtggcgtgtttggaaacagtttttctctggttatcatttaaaaacataattgaagggaactagtctccggcttaggatgcactgtaattgcatcagtactgtgctccagatgagccattaagacaaattgcctgtaatcccctgactggggctgcaggcagtcattaggtgtgataagcaccaattattccagaccttctttccagactatgcaatccattttttctctcactggctaatgtttcttcaagttcaccatctattcatggtgaatttgctcaaagtttctgtgctcccctcacacaacaggtgagtggaattctcagatgtgtgccctgatgacctttcaggaaccctgctctttttaggagtcaaatgaaaatgtaatgcagttttcactgttttactaataagaaggaagtgtgggtttatcttgcaactgtcctttccaaggctgcagcagttgtttcaattcaagtacaaccaggaaattagccaatgaactacagctgggcagactgtactcattgccctggtactagatacctgagccttaggaccctgttcctaggttaagacatgttaaactttttttttttttttttttttggttttttgagacagagtttctctgtgtagctttggagcctatcctagcactcgctctggagaccaggctggcctcgaactcacagagttctgcctgcctctgcctcctgagtgctgggattaaagctgtgcgccaccaacgcccggcccatgttaaacttttgaggtatgaactgtaccatcattgagcgatttttatccacctcattcagtgtctgagacactgggaagggagagaaagaaggggagtagaatccaccaagcaggaagtcagtagcaaagtgtctgtataatcagggtgaggctggggacgttgggaagacatttcaaaataaatttagacatcgtaccctaagcagaacagggggtggaaagataagagcccgagatggtgggtgactacaatgaagtagtgcagctgcacatatgaacaatgtagctgtgagagcattcaccaggcctacacacaacacactcaagacagagaaaaccctgatatggaattggggaaatccgcaggaagtcccatctctagctgaatgtagtggtttggaagaaaatggcccccaaaggcagtggcactattaggaggtatggccttgttgtagtgggtgtggtcttgttggaggaagtgtgtcaccgtggaggcgagctttgaggtctcatgtatgcttaggccatgccctgtgagacagttcacttcctgatgccttgggtcaaaatgaagaattcctcagtatcatgtctgccatactcccagctgccatgctgccttccatgataatggactaaacctctgaactgtcagccaccacctcaactaaatgttttcctttataagagttgctgtggtcatgatgtctcttcacagcaatagaaaccctaactaagacaatgaagatctactgacaactgctagctaatgagagacttttttttttttttaaggatatgacctcctgttaaatcaaccatattccaggagaggaccacacacacaggaatatttagatagcacaaattggacatgaaatagggtaggatggatagggaggtaggaggggaaggagttggggagggtggatatgatcaaaatgcattgtataaaattcccaaggaattaataaaaatgttgtttaaacaaaaaaaatccctaagaaggaaatggaaacttgccggaactcataaaagtatgtataaatggctaagttttataaaatgtaaaatatttctcaacagaatttttattttatttttaaaaaggagccatcacagacacgtttatttcatgcttatgaggtctctgtgatgtcagtgttaatagttctgacatgttcccaattattcaaggtcactcaggaatcaagaagagcatcaagaattgagaccccctttcttcctccaaagctttagctagttcctagccattattcctcccagaaggcaaaggcttgaagtggcctcaactgcagtgtacttatgaagggaaatggattaaagccaacaataagaagataataaaggttaacgtttgaagagaaacagatttatacaaaatgattaaaactccattagtaaagaatcaggaatggatttatttaatactgtttatgcttatatctcctactataaattacagatggaaaagtgagaattacggaggggaaaaaaaatctgcaaaacaataaaaagccaaaaatagacattttaaaagagaacacaaaaaggtagaccccataggaaaccaacaaattgaaggtggaaggaggatataagcagaagtaaatgagctatacaagctctaaggactcaggctgatacctagtttcaggctttcaacacacacacacacacacacacacacacacacacacacacggcaaattaaagcagctgtaattacaagagtgggcagggagcacagatatgtagaaatacagggtaagattacaaaagacttttagctttattttttaaaactttttaaaagatttgttttattttatatatagggatgtttgacctgtatggatgtctgtgcagcactgtgtgttcctagtgtccattaaggccagaagagggtgttggattcccttagactggagttgtggcagttgcaagctgccatattggtgctgggaatcaagtctagtcctctggaaaagcagccagtgctctaaaccactaaacatctctccggacctctcctttaggtttgtagcatacagcttggtatgggttcatatccataccaaggctcctatttgagtgaacaaaaggctattaaaagtcactggggtcaagtaaagggaacttgagcagagcacacagctagctagctcatgtcactgccagagtctgctccacccacttctcagtctctcccattcactttctacaaccactgtgcttttgaccatcaaagcctggtagttttacaactcatatgccactttttttttaaaataaagcagcacaagaacagtcaccatcatccaaatcctattaagaaatgcaaaaagtatcagaagttttcacctttttcccccttaaaaaataactataaaatgattccttggctgctgtcgttttcaagttcaattctaatcccatgtgtgcagtcaaaagctgccatgaacatcctgtgtatttgggtgagtccaagagcaacgggggtggagatgggcctggctagcagaggcgaacttcagaggctcccagggtttggggtcctgagggaaacaccagggtagggcattcaaaaataagattccctctttatactctctctttttcctgaaaattataattgggagagacagtgacccaaatacacccttacgttctatttcccagatgggagaataccagtgggattctctactccaagtctaaggtccattgttgccagacagaagcaaagtttcttaaatacttcattactttatatgtatgagtgctggcctgaatgtatgcatgtgcaccatttgtgtgcctggtgcctgtggaggtcagaagagggtgtcagataccctggaattttacagacggctgtgagccaccatgtgggtgctgggaatcaaaccaaggtcttctgcaagaagagccagtgctcttaacccctgagccatgtctcccatcaggagacattttttaaagaagagtttatgatgtgtcttcttcttgaaggaaccatttttaaaaaagagaatgggcccaagaagagccaccaacttaagctgcaaaacaaatccaaactatctgaaggggacaacagttcttttcctgaaggacttcaggtctgcactgtattcttactgccaggaactctattccttgaaaacctaaaatggacttggaagacaatgaaaacatttttaaattaaggatttaaatctttctaaaggatacctacacacaaacctaagcagtgcgaaataattgtatcagttagacatagaaattcgccataggcacaattccaaagaacactgtcccccatcattagtattcaccctgagggttaccttagcaaccaaagggatagaataccagtttagtgtgtcagaaaagaatgtgtggaaatgattgacccatagaaaataccagaagcaacagaaggctagaaagcaatactgaatatatacaaaattactttaaaaaacaaaaacaaaaacctatccaaaagaaacacacaagccaccaggaccaggtgtttcccagttttccacaatgcactaatttcaaaactcagaaagaaaataagcagaggaatttgtatgttggactaaatcttgcttgtatcggtttcctacccactggtgtttcagctcgtgccattgaaacttgttggctggtacaaagctttgggtagaatgacaaaacagacaggccccatgatctgcaggccaataagcaagcctcatgctccagcactcagatagggacctcagtgaaggtagcccagggaagggcaactgcactggagcttcactctccttccctcctagtacactagttactaggatgaagggggcgcagctccatcccaaactcatcccaatgtggcttcctgcaggttacaaggctctttccatgcaaataaaaaacaaatttcctctgcaaacgctgctgaccatacatcccctttctctggctgcctagaagaaaggggatcggtgcatgtgacatggagcattatgtccatgtgtgaatgctgatggttaagacagattcacagctgctgaagaacccttaatcttacaaactttcctctgaagccctgtgggctttgcatgctctctcattagctgcaaagcacggagaaccgagaattcttcagaggatgttaatgcatgaagaccctatttagcagagcatagtcatgctaactgcccatctccattgtgatagcactgtgttactttccctgcactgggcatggcatgtgtgcttcatgacaacgttcagtttttcctttaagttcatgctgcaaccattttttattcaaacaagacactgctcaaacttgccctcaagaacatgtactttgtgactggtaaatcatacctttaatctctagatttgcatttaagtctaggatgttgtaatcagttacagaacagattcttaatccaatcttgcattaaagaattaagagataccatgctctaacctatctccactgggtcctgccaggactaccaaccagccctctttgatgatggatctctacacagcaaatacccacagcctcctagatacttgggctgtgtttaaagccaacactgccctgaagaaacattgaaaggaccaattggcttatcttctgaattccctctgtaggtagaataaaaacaggaagacagttggcctctttaaacttcataaagcaacttcataaagatcaaactttgttttgttggaaatttactattttcccctgcagattcaacaccatgttgaatgtattggtggttgttaacagaacccatgtactccatcaggaacagaagaacatctgcccagaagaccctgaagtaagtggccatgtccatctacagtttttcacaataataatttacccttatgggctggagagtttttgtgttaatctgacagaagccagggttatctgaaaggaaggaaactaactgagagggggaaatacgtccataagatccagctgtcagggagggcccagcccatggcaggtagtaccatgcctaggctggggttctgggttctataagaaagcaggctgatcaagccctgggaaatgagtcagtaagcagcacacactattctatggcctctgcatcagctcctgactccaggttcctagcctgtttgagttcctgtcctaacctccttcaatgaagaactacaatgtggaagtgtaagccaaataaacactttcttccccaactttcttttggtcatagtgtttcatcactgcaatagaaaccctaactaggacaccttacaaagcaaaatcttcaatctgccaattaatgtgtatgtattaatatatgtgaaaaatactatttatgtgtcctttttaaaagaaggagtccccccacacacacacacactgcaagagctttaattagaaggcaagctgtatctctcagtaggctggcaaagaagtaactatgttcacaaagccagtgtcattagaattgaggtggccacatggcagcctcctcctggtgaagcctggcttaccagccatccctgtcgggcttctgggaacacaaatgcagggaagccatttggttgagcaggaagggaagcttcaactcaaatgttatctgagcaccaatcagtgagacattagaaaattttatcccagttaacctaattgtctacattataccaatctctgcaaaaacatttctgtcaaaacacaaacaggcaagaaacccaaaacaaagcagataaactgtgacatcttcttgggtaattctattacttcactcagcatcttactgcaaacaaggagttcaggggccctgcaagagcttctatcataaaagctagctcacataagaaatgggtttaatcttatgaaatagaagcacagtttgatagaaggcctgaagttaaataaaacctggggcacttccttctattgtatgtataataaggttgtactatgactgatgatatgtaagatagggaccaagatgagaccctgcttttctaaggggtgccacgcttcactcaccatctctccctgacaaccatcaaaagtaaaatgtgagaatttaccacaaaagacagaggaatgcagtaatgtctcatgataggtcttgggtcggattatttatacaacaaagctattatcaaagttaactaacactcctctgctaaaataatgtttacacctaaagaaatcattaaaaatggataaaaattttgaaggataaatacagaaaattttagatgtttctgatgggtactaaaatagataattgctgaatggtttgcagggccctttaaaaatactaaagagaacaacaatgtgatccagtgattccattgctgtatatgcaaaggcaataaaatcagacagctagagaagcatctacattctcatactcatgacagccccactcataagagctaaaaagtaagcaacaagtgatgaatgaagggagaaaacatggtcatattcaaaacggagtactatccatccataaaaaatgaaaccctgtcacctatggcaactggaactggatggaactggagaccattgagttacagaaaataagccagacacaagcagaccagtaccacctgatctcacctatatgtggatctcacagagaactgtcatagaaactgaatcagatggtcaccagaggctagggtggtgggggaaatgttgatcagaaggtgttacattacagctagactggagcaaagggttcttgtgtaacagcaactgtacatttcaaaaggctacaagaaaggattttaaaaagttttaaacacaaagaaatgatgactgcttgaggttaagtatatttaaccaatttaaacattacacaatgtacacgcctatcaaaacagtactcggtgataggtatatttttatgcctatcaaaacagtactcagtaaaggtatatttttatgtttcttcatttaaaaaagtgaattgaaaacacaatgactaggaaggaaactggattctgcttatgactgatgtccccaccaggaatacaatccgaattctcatgggcccaaccctcagcctagtccttacgtcatcgctatactggcaaaggtcaagagaccaagaaggggattctgagaggagaaaacaaaatcaagttggggttgagaaggaagacaaagaagaaagagggcaataggatacatgtgacatagaaacagtggtcactgggggtgaaggagaccaatactgtgggcagagggctcggaaaggctagtggggtcagagaataacaagaacaaagcactgcaaaaccccctaatgaaacacatttactgtttgtaccagttttgaaaataataatatataaataaaatatgattcatctgtgaaatcccaaattaaatataaagtgatctgcacagatcccacaggcaggagtcccaaggttcccaggataagtatatcaccagacttgaaggtacttttgtcaactatggcattaggaactatttttccagatggtacaatgtcttactatcaaaaggaaaggaattgtcttcctttttctcttatccaaaaatggatctctagacagtcttgaaaacagcagcaggacaacagttggcagctacagttctctgaaccttatttattatgtatatctaccagaaatacacacccaacattgggaaatcatacacacgcactactgtaaattcccaggggaaccatgcacacatactattacaaatccacagatgtagaaaaccttaaattctgaattttgatgtggaaaactaaaagcagcaagtatgcaatacaaatttctcttcggaggctcacggcttaagcttgttcatgtgcaggctcattgctagttgatactcatggattcctcttatccaaggtctttaaaaaaatcagagccaggcactggtggtgcacgcctttaatcccagcactcaggaggcaaaggcaggtggatctccgtgagttttggccagcctgatctccagagcgactgccaggataggctccaaagctacacagagaaaccctgtctcaaaaaaacaaaacaaaacaaaaaaaaacaaaaaaacagaaacaaaaacaaaaacaaaacaaaaatcagagacattcagaagtgcctgggaaggtttgtaataattctgattgaatggagaaatgaatatcatgtctggttatagataatggcctcagtaccctgcttataaaaaccatagccatcacttacagtggtacagtacactcaatctcacccacgatcaaatttaagccaattgtaagtcacacccaggagtaatcagggatcaaattctttgaagcagcatcatccaaccacaaagctgaagtcatgagaggaaagcagcacattgacaacgtgccatgtcaagaaaacaacatctctggattttcaacaaaattacatcatttgtaatcaccttaagaaacagctactggtgggctggtgagatggctcactgggtaaaagtgtttgctgtcaacctggttttaatctgtgggatccagatggcagaaggagagaaatgactcttgaaagttgtcctctgacctccacatgtgcacaaagccaaccccccaaacacaatctaaatgaataaatgaaagcaactttttaaaaaggaacatctattaagcagttttccttcacacccaagtgggtttatatatgactcccatagctctacatatatcatagcactggagaacaagaattcattcacccttagtaattctaaaagttagtgcaaatgtaacacaaaggaattacacatatctgaggaagtggaactaataattgctgtagtttggccaacatgcattattcacatgtatataatgatcgcagtgtaccctgtagataattacaatgcgtgtcaactgaaaaacacttttgggacagggtctctgtaccttattctagctcacctggagctcactatgtagagaccagactggcttcagactggcaaagacctgaatccactcctcagttaaagtttttttaaatctataaatgccctgagggaaactgactttgtatgtatgtgctaatgttcccacttgcaagtccatgtgagtgtgcatgagtttgtgtgtgtgcatcagtgtatatgcagtcatacatttgtgcctcgtgtgtgcatggagaggccagagtgttgcttttcataagtcaccatgcattgattttttttaagacagtgtctccagttagagctagaactcaccaattcagctagactggctggccagggagcccagagattttcctgtctccatcttaccagtgtagcgttacaaatgccccccctttttaaatgtgggcactagagacggaacttaggtcttcaagcttgctcatcaagcactttccactcagccatctcatcttccccggtctgactcttatgttgcagtcgttgtttgttgttcatcagttacctttctttcaggatgcatctcttccaaccattacaaagagccttttttatcctttcctatttggataatggcaacaatgtctccttctcatggcatgaaactggccaaaggaattagagccacagtccaaagccacaggctcaagagccagccataaagaaacaatatcaccaccaccacagacaaagcccttcaatggtacctcctcagacctcctgggacccagaagcatcagccagccagccgagagatgaatggctgaagacttcagagaacccagccacataagagctaatggtttagctaaaaggtgggaagaaaaatctacccagagaaacagatggtaaactgtaaagtacattcttgacttgaaacagaaagcacacaccgcacatctgagttttctgacagacctaccttcaagtgaggaattccccaggactgtccagcccaaaggcagttccagttggctcagagccagcaccagttcttcatccaaggcaggcagcgcttctgccgtcagggcaaatggggttagcagcatctggtgactacaggccgtgagtcggtcagcctgagtgaccagtagacgagccagtcggcaggccatattgtccacataggtcactgagccagagcccatggtcactggagagtacccttccgagcagagacacacagacaccatcaccgtctcctgaagccagtggcctagatgacaggatgacaaacactttagctcatgtctgaaggagacacacagtagccctgggtaggcaacactctccaggggtcaagtagaaagtaaggtgtcatctctaaataccacgatcctggggtcactccagagatgatatctttttttttggtgatgggttttaaatgatcctttggaacttcagagtctcttcccaccaaccaccgtcctttgccacacttcctttcccttctacctaagccctggattccagtctgccatctgaagggtcttcactatttctgtcctgctataaacagggtcacacattcttagccatttattgaggtaacagattttttaaaactgtatcagaaatatatacaagtgcaccctaattctacagagcggctttgaaagtggggtgaagaccccttaactagactctgtgtgcatgaacacattcaacaaaaagcaggagtttcccagggccccctccagaaagggcccctgtgtcctgtcttctcactacttccagtgtggctgctcaccctgctccctgctctccttacactcttctttgtcttgctttcccattctgctaaggttggcgaactgctgcccagctatgtgtttttttcctttggtagaatttccaagaagtcaatagcttccaacccctgggaccatatgatggctggactgagaagagtccctgaacttcccctgagcacaatgcccttgtactcactagcaagtgatcataggtctgcatcctcctgcctgcctgaccctccaagctttcccacaaaggctatgctgccggaattccaaagaccaagagcatcagggttactagacaagattcgttggcatcctcataatgactctcaaaagatgccaacccacagacagtacctattgagtatagattgcaggacatactttccatcacttggtagatgaccctggtgaagctaaccattcctaatactcaagggttgcctcactgaatctataatcagataagtttaaggttaacaaataaactgtcactcacccacagggaacctgacaaaatgaagacaagggctggccctcactttaagtgggccattaaataaggagagatagctttagcacatcagagggcaatgaggttggtccctccaggtaaacaagaaagaaacaaaacaaaaagttttctatcacaagggacatttttgttatttttattctttttctataggttgctcattaaaagggaaaacataaggaacctggaatagaaaggatgtcaatgtattggcccagagtaaaagggtagcagggaagggaccaacagcagaatgacaagggccattaacaaatacagcagtatgattgattgattgattgattgattgactgactgactgactgactgactgattgattgattgattgattgatttttgagacagggtttctctgtgtagtcctggctgtcctgggactcgctctgtagaccaggctggcctcaaactcagagattcacctgcatctgcctcctgagtgcaaggattaaagttgcatacaccaccacctggcatttgggtttcttttgttatatatgaattcctggggctgccaggctgaccacagaggaatgaggaaggagaatgaagacatggtctgtcatgtcaccttgtccagagccaactcaggcatcaggctgggactaaggaggtgacacccaaggcatatcctccattggctgcacactagaccttgagagctgtgggcggcccgttggctaagcttgctgggactaagtcaaggtagacactattggcgggcccccaggagttagtggcaaagagcaagtgtcttccctaacagcatgcacatacacccacatgaactcctgaccttggctagtgtttcttcttttccctcgtgattctcctctggcagatgccctggagggaagacatagatgtgcaccccccatcactcagaggcctcctcacctggaatgctggattggagaacattatcctcggtgcgctcagcaatcactacatgtctctgctgcgacccatcataaataaagtaaaactcggcatcttcaggaagataaacatttttgccaaactttgcatagaccgtcctctgtccctgaaaaacgagtaagtctgggcatcagtacacttccttgttctggctctgagaaaccacaggggaagggcacaggcccacaacattgacacttgtcatatgcacttcatgtgagtgagctcaaatgtcacagagcctccgaccaacaatgaccttttcccaggaacaccttactgatgtgtctagtatgggagtaagagctggcctacactttctgaaagtcaaagaagatcaaggaataggaaggaatcattcttttaatttgctagatatgtgactgtgatttttttcagtaccttgaattcctactccccaaacatcactgtgcataataatgttatcccatatgtgaaataccactggcctactagaatcgcaatagttattcttagcttaggccttagcatgtgctagaccactgtacaatacattaaacataaatactcacagacatttttcatataaacaagagtttttactcacatgctgtaccaactgccttgaccccgtcttctctgagtgaccccatgtcctctgagtgatgtctaagccctttttatcatctgggttggcctcctcttttgtcttaagagtttctggctaatacaaagccttacaaagtgtcctggttcccagaagaagcattcctccaaaggaatgacaacagagttgtggtcttggtacaggaggccttgtcaggggctagctgacagtcaagcctgccaggtcatcccaggatcctgcaggcctcagaggattcaggatgctccctgcctggagtacacaaaggcagcctagagcaggtctccagggagagaggatgcattctgcccagcccaggggagtgacagggagatgaaagccaggagaatagatatctactctagagacttgcacagcttactcgatatggagaaggctctgggtgtctgtgtagctgcctaaccaaaataaacctgtttctcatcctgggaaagggagaagaagccaagaagagtcagaataaggctgctggacatgagtgtcagtcccacagtcccctacagcatgacactgcaggatgctaacagttaagttaaggaggagcaaaacaccagcccaaatggggctcctgcgcccagtgaccatatcattatttgatctaaaaaaatgtttttgaaataaaaaatgctgtcttttcatactcttgcaatctcactctcagaaaggcctctaaaattatgaattaaaagtgctttgggaaacacactggtgttcagttccaaattttcctgtctttgcatgtaagcgtgtgtgtgtgtatgtgtgtgtgtgtgtgtgtgtgtgtgtgtgtgtgtgtcacacaaaggaattgatagaaagtgatgtgccaaggaaaatctaccatacaatagcttcagaaagggaacaggaaggagagctgaaaagcaaaggacaaaaacaataacacacatttgacaggaccgaaagaggaaactcagacgactttccatttcctataaaatgaagaacagattgctttagtcgtgttcctggttgctaaagggctgcaaactctccatagatagaccctgcactggcctactagtggttttcttaaacacagaacagattgtataaatagatcaaagattttcacagatcacaaagatacctgcatcggctccaaacaatggtcagattagtccttcgtttggcaaggtcaacaaggactatcacttaggcaagagcttcactacaacctttccaggtccatccttccctgactgcatagtcttgatgcatagtgcttccctctcgagaccacaccacgcttcacgatggtaaagacagacaacaggatacctcggatacctcgagagaggtgacctagttgtctcagcaacaatgatgacactcagaataaaagagatctcccacttagtgatcacaaggatatcagaaataaatcaaggattctggctaggaaaagagatgatgcagaaagtcaacggaaggagctgaggagggagaggcaggcaggtgctagaggacagcagagaaaggaaatctgatggtaggagagtaaaaatagtggtggtcaggaaaaggaacaggaggctcaaacaaaagctgagctgagctgtgtaggagatccctgggcagtgactactgaaaagaaagggctgagcgtgtgaatacagataatcagctgcagggacagccctaggctgagactgagctctctctggcctcagaggccactgaaagtctgccactctcttatgaagccactcaattcccacatggtaaagacagactccgcttacaaaactgccacatacaaacctcactcatgcccccagttgaactcaagggcaggctttgcttttgacaactgaaaacaataacctgtccaaaaaaaaaaaaaaaagctggatcaacgccagaatcacaactgcagatgggtgtgttagcacctttcggtgaattcactgggccccacatataaaattcaaatacttcattagaaatatagttcattgaggggctagagagatggctgagctgttaagagcactggctgctctcccagatggccagggttcaattcccagcatccacatggcagctcacaactgtctgtaactccaattccagggaatcttacattgccacccagctatacatgcaggcaaaacaacaatacacagaaaaaataaaaataataaatcattaaaaagaatagttccttaaaacttctggaaacaatgagagacgtataaggcaagattatctccccaaattaatctacaaatttaacatattccactcaaaacccaaactgaatatgttcaaggaaaattgaacaaaattattcaagagtccatttgaaagactaaataagaataaagatttggacaggaaataatatttgagtggaggggagagggaaaagctcttattattgcaaagcaaaataaagaataaaaccaagatcttgtaaacagtgtgacagtggcaaagagacagaacccaaagtagagaccagagaccaacacgaggacacatggaaattacataagaaagatggtggtgtctcagataagtagggaagaaatggtttctgcttcttcaagggttcatgtaccaacctgcatgtcctaaggactttttccttagtctgtctctctagggtgactatattagcccaatttctgggatttctcatgctaatgttctcatccaccatgcaggacacatatgtatagctatactctgtcaatgagaatattatttgctaggcaatctttactttttagtttctaaactatctaacatgcttggacaataagcaaagtactttcaaatcagataatgagaacagaatggtgcatctgtttatggtggacttctgcaatttagggccatagaaagagtttatacgtggatttcaggtagtctcagtacatgtaaaagtcattaaaaagactgtttctgtgtatatggatccatttattgagagaagggttattatagccatcataatcatttcaaaggtccactgatttttcacaggcttatggtgttagcttttgtaagaacaagcaaaatgaaagctcaacacattttttatggctctttaatggtaattgtcaacttttataagatgatcaacatgttctgttattttccaaaacattcaaatattatacacagcctctgtgtgagagggctttagggacaagagcatgagaaaggttaatgtgaactgatacagtaatttaactatgaaagttaactaatatatgccataaaaaccattattctcttacatgatagtgtaagtgaactgccaaactttgatattttttatatttgaaatatctttattataacaattctgtacaaaaccttccctgtagagcaaaaatctttgacaagttttaaaacaacaaaaacccaggataactttgcctttttataggaaagttaaacacactgcaggaaccaatgagtcttgaggacctgagagttagacacacagcattgtgtatcttgatttctgccacacatccaagccaattcacttcctcacaattcatcacccacagtgtcttcaggtgattctaaagaaagtgatgagggcagaaagtatttcacatcaaatttctgtgtgtaactaaagaatctcattaaaacgctgggcactggggagacagcccgtgcacaataatgaggacctacattgaaaaaaaaaaaaaaaagcacaatggtaaacacttgtaatcccagtacttgtcaggtagacacagatggatccttgaagttcactgtccagccagtctagcctacttgacaagctccaagccagtgagagactccaccccaacatccaaacttaacagcatcctaagacaccatatgttgatatctggtctccatgcacacacacacactatagttagaaagtgtttccttattattttctcacattattctatgagaacccctatgaggtactactgtgacccttatttctaaaggagaacactgaaaagatcaggtctcgtggccaacttggagcttcctgtgccagcctcagcacccttttctctgtttcacatttctgcacatcagcaaatacccagctgcttggtaacttccctcaagttttccatttggtccccttgataaggggtgtccaatcttaaactcctaggtacagtcaactcaacatgtatttgagacacttaacacaaagctgctcttcctaaaacccataggtgggagtgccatcccttcatctccctgaagatatgtgtgacagggacatttacctatagataattctctctggtaagagactcttagaggacaacacaaggtacatatgatccaaactagttaagaaccactgaattaaagcctgtttaaaccaacttgttttttatagtgtaaaatatcagggttactctaacctaacacccaacaaaattaatgtcaacacaaattggttaaaatggaggagaaatatcagaatatcttttttttttaaggaaagcttatttccttataggtcaaaagactcacaaaacatctctttagcagttgcctttggggaaggaatggcttctacgtccagataagatgaaacaaacaacaaaattcaacatttatcaggtagagactagggagagagacaaattaaaaggtccttcttcttcaggacatcagagtaggatagaaactatgaagaccgcagtgacagatgtcatgagacagtagaacaagtttaaggggatgattgaagctcacactttactgaaattttaatgaaatttatttatcaacacaaacaataactgtaaattaaaggtgtatgttaatgttcaggaagtggtccattatccaaatttatgcattaaactcagaaattcaaaaagtataaacatacaaaccaaaaaggtcattgtgaccttcatacaggatggactgagttgccactctgggattgaaatgacctttgtttctctaacagcaaaatcgagtgaaaaataattcaaggctgagattccctacaagaacagagcagactctgcccttcacctctcccaggatccaacccaaggccgcatgaaagctagataaataaatgttctgctgagccacagcactagcctcacaagtaggctttttttttaaagtgttctcatagattaatttccaaattataacttacagattacatgatactgaatacaaatacctgacatgcttcccgcatggcagtgggaagcatgttgggtgggggggctgagacagtagaaattatcatttccatactagggaggctggggcaggaggattgcagtgttttgaggctagcctgtgctgcatagtgaatttgaggttagtctgggatacatagaaagatactatctcaaaaatcaaaacaaaaacaaacaaacaaacctgcattctcacaatattcagttggtctcaaaataatctgtcacaacaataaaatgctgtttaacaactgcacacagggtgggattttagttagtaactagttaccatgaatcagtcttgacagacatgaaatgccaatcctaccctgtccagaaatggagaaacctagtaattcctctaggaatgaaaatagacacacttaggccacagaatgcttcagtctaaaaacagacaaaactggctacatgtttagaggaaagtgacaaagatgccaaagagatgcaaaaggcatgttgtcacaggaagaacaattgaaggaactggagctgttttgtcacacaagagcagactcctgggtaaacagtcacactgcaaatatctgagggtctgccatgccaacgacaagggattagatgtgtgctgggggtccctggggagatcccagaacaatggagggaaggctagggacagagtccagctccctgagagcattgtgaggaccagagaagtacagagctgtcaggcttcaacataggggaatgaacactaccctgagacagggcacttttgtggctactgttgtatttctgttttgcttttctgtgtgctctacaagacaacagtgctaaaccatacccagccctgtgagcccagagcccacaccacctgctacagaattacagatgaattgcttcactgaataactgagtacatttcattcctatccattcctccctgtgctttgctcttgggcaaacacttaactcagttatgtttagtcctgtgtgattttcaaacaaaacaacagaaccccatagttctagtggaaggatattggaattcacaccattcaaatttcatttgggaaatgcatttcttcttctttttagaattaaatcttaaaagactgctatttgctttagtggattattaaccaattttaagaccccagagaggctccaaaccaccaggctcagttgagttgaaacaagtaatgaatttaaaattaaagaataaaatcgtaatagtagattctgttaaagtttatattttgaagttccctataatgctctggggaaaatatttctcctacaaaagtttccgtatcacttcttttgggttttttggcccctctattccctaacagaagacaacactctatcagtcaccagcaccaccaatggtctaagaaaatatttcccatacccattttataatttatgactcgaacagcttggtagttaccacaccataaaagactgtgaggtcccaccaacactttggaatcttgctgaactggcacagacagcaaccacatgtgcttgttatttaacatttgaggactgtgggtttatgtcaaaccaaatgctatctgatggtcagcgtagtttggctgacagctttaaacatgccaaacctaaaccaaaacacacaacacaaagagccttaagtctctgtaaattgatctgtcctgggcaaagaatagtgttataaccatcaaaagtctccctgcaggggcagaccaaggagaccctgtgctccacaggaaggccctcctaggaggtgtaagagcaaggaacagtgctttttgcccctctcttctgggcagcagctgagcacacgctgcaccacatatacacataccacagagcaggttatccctaagagcactgaagaccctgccaaggaacaccaagcacaagataaagaacctagtcatcctcagcaagagattccgaaattataaacaaagttcatttagatccaagtccttagtttataagtaaagatacagaagacccaaagagcccatgtcatggctctccattatgttgcttcaagctcccagaagagcgccaacctctgaccccccaaacgagcccccaccactgggaaggacttttattgaaaaagtcagaaataaaatcaataaccttctaccaagccccacttcataatggccctctcccctaaaatgtctcctgtcacctggactaaaagcaaggcagtactattctcctccatctcccccttccaagtcacagcttaagcaggtaaaatcctgaaccttcccctttcacagcatggaaaacaggaagcctaactgactgagctgggagaaacgtggaggcatctgggaagggcatcgagaggggcgtcagccccacccttcacacggtgcagggaagccagaagaactctgctggggcagatggaaagtaaaaataaacagcagcagacagataacaatgtcgaggggaggaagagctggaaaaggcagcccaaaggaatgggatcaaaatcgggagctggagaatgcatcgattcacggaaataaaggagagagcgcagtctgccagggacaacagcttggaaagcttaggaaggaacaaggaggtagaccagggagaaaatgggcctctgcttggaagccaacaaaccaggaactgagggtaaaagaggcgctttgcaatgttatcttttcctggtagtggcaagtaagagtacttttccaaagcccttcttcccaactaaccacacagcatcaagttgctaagtctgtctctcagtgaactagaccacaggtgggcggagtggtggcactcttggaaagaccggccccacccaaagagcttgtcttattctccatcccgttcaggcagagagttggctggcttggtcattaaaaagcagcttttgccagccctgtcttttcttgccccttgttaattcattctcttttgtgttctcacttttgcactcttgatctaccctcctcttctcctttctcccccgccctgctcaagtcaacggtttgggactctaaaccagaagaaaacagacctgctatagagatgccaaatctttgctcccccagaggtgtcatctgaccaaagtaaattagggtccacccttcctctatacttcagccagcacaaggtccagaagtgtgagagtagcaactatagccatagacgcagagagttaaaggagaagagcctgagagtgaagttaatcttgttaagaataatccttcctcagtgatgctgtgcaccctagagacaccacaggtaagtaattggctcaggattctcctggacagcagcactaaatgtcctcatttatccatttgtattcaagatacatacagagaatacactaggtgtttcggctaaaataaataacctgccctcatcaaactcttctagtgggagacacagacactaaataaataattctgcatctgataaggtcataagtgcagaggaaggtaatgctgggtaaggagaacaaagcgtcaagagcctctgatacaatgttactttaatagagacctaaataaagtaaggcacaaagctgtgtggacagggaagagcatatgaggcaaaggccctgtagtaacaagaactggagtgtgtaaaaagcagggaagaaacttgctaatacatcacaggggtggaggaggcaaggtcagagacaagcagaggccatccaagggacttggctagtgagcccaatctggagtagaaaagtaacgaaatacggtgttcaaaggatcattctggttgttttgttgacaataaaccataataggacatgtttaaatgtgaggaagccagtccatcaacccaggcaaggtctgagcggacatcctgacagagcagtgtctgtgtatcactgaagcattactgggattctgtcggccgagaagggctgatgcagttgtttttgagactacattggcatctagctctgcttctcccagatcacagcagctccagcaaccaccacagcagaaagcaacactttctagaagccaaacaggtaactgcagtgatctgatgctagggtgggcttagaacttggggccatttttgccattcttaaagggaaatgaatgagtagaccaacgagagagtaatccctctggtggcttttaccagcaattacttacagcatacaataattaaatggccatatgggtcaggtagcattttttaactaaacatggaagtcgctttgagcatcctctaactccagctgcaactattgggattaacaagattcagagttttctaatttcaactatgacaaaaaacaggcacattcaacctgagatggtttacagaccattccatggcaggtgcctactgaagacaacacctaaacattgtcagggtccctgccatacaggcattactatagacattgtttcaatatcaaatatggaaaacgtggaacctcaatgtgaaaacagtgtgttgataatttgaagttgcttaaggataaaaatcgccaccacaggagtcctcgatacctttaaaaactacatctgtatgcttcaaatatatggcattctggaaaagatagaactatggaaatggaggaggggagattagtggctcccagggtatagtgagcagagaaactgtgaataagcaggtcattgtattagttatcgtttgttggtatgccaaaatgcccaacaaaaaagaaaaaagaaaacttcagcaagaaagggtttatttgggcagcttctgagattagagtgcatcatggaaggaaaggcatggtagcagaagcttgaaacagacaggaagcagagagagaggtgcatgctggaactcaggcccctttctcctttgtattcagtccatgggatggcaccaccaacaagaaagaagggccttccctcttcagttaagcctcactgggaaatgcattccctggaacatgcagagaagtgtgtctgtcaagtgatttcaaatccagttaagccaacagtgaacatcagccatcactgtggtttgtagagcaatggtggagaggtgtcattgctctttagtttaagctcagaagatgcgcagcaccaagagagagccctaaagtgcctggtggacttcaggtgattgtctatgcagctcttcaagtgtaacacatgtgccaccctggtgaagtgtgttggtaatggggaaagccacatgtgtgaagggagagaacatatggaaatctcggtgccttctgctcagttttactgtaaatctaaaaatagtctttgaagtaattagaattaggccccagtgatcaagagccacattcagttgggtaagtcataggaagcgctcagagtcaggcatgaaagctgagatcagaatggcaaggtgtgtgtgggtttattcaggagggaaagtaataagaatggcatgaaagggaaggaaataaaaatggatagtgaagaaggaaaaccaattggaacatcaaaggcccaaacacaaaacaaaatggaaggagtaaggtactccttgaactcagtgacagtgagatcagcaagaaggtgacacagttgctctttatagagatcccagaaagctgttggtatcacaataacaccacatctaacagtcccacagaaattttgtttgaataactgctccaagtagtggtccaggtcccaggttcctgccatcttgcgactgtaagttcccaatttgccttatccatttcaaccagtctgaggaggaaaatcatagaaaaccgtagattttcaggtctgtgcatggtacccatctctagcaccaagatgtggctggaaggtattttataggcaagtgtccaggaaaaggaaggaatggtctgattatgggctccatgtctaccataagctctcattgaatgggtgaagcccacagaacatctaaggaagagaaggcatggcaatgggagctaatcacaccacaagccaaggtcaatcaaaagtgaagaatacactttaaaacaaaacacacacacacaagaaaaaaaaaaaaaacatgagaagagagaaaaaaaaacaaaaaactggagactcatgactcatattggaagttctggttaagtactattttcctgcccagaaagcttttcaaaagcacattcccctctcccccttccagaattctcactccaagtatatttaccccaaatacagcatcaaaggctgtactgccataagaatcccttaattcgggagagaagggaactgagagaagcaacctcatcaataaaaaaattgtttatatcataaaggaaagccaccattcctctggagaagagctatttctgtgaccaaagactaagttatggctgtctgcttgtattagctgtttctgtcattccacaactaaataccttgcagttccaaaggatacagttaatcgtggcagggaagctatgctagtaagaactgaaagtagctgctcacattgcatccacagtcaggaagcagagagcaatgaatgctccaacccatgggatggtgttgcaggataattgtacactgtgtaaagacgtgccattgtgattgtttaataagaagctgaatggccaatagctaggcaggaggaattaggtgggacttctaggcagagaaaggaactctagggatgaatctaggcatgaagatttcaatagcatgacatggtacaagtcagatgcacggtactgaagagaggtaaagagccacatgaaaaaatgtagattagtaggaatggattaatttaagttataagagctagttggaaacaagcctaagctaaggctaagctttcataataatgtctccatgtcattatttggggtctggtggtccaaacaaagtttgataagaaaacttgctacagacaggatgatgccacatatggggtgggtcttcccacctcaatcaacttagtgtggaaaatcctcacagacacacccagggattcattcccatagtggttataaatcctgaggcgctgaccatcaagattaaccatcactccaacctgtaccctttgaagtcacccaaagtccagcacaagtagagtaagttttttaaaggcctaaggctttataacttacctatcagaaagtaagacaaatctcattccatatgccccgtatttcttcaaaactgactatttaaatagcaacctgctgatcatacgatggcagtaaccttgagtttcttcttaaagtctcctattgagtatgagtgttctgaggctcccaactgtttccttaaatgtaaatgatctcaagatattacacaagacccctccttttgaaaacatccttccacaactaagcctacacacatctccaaaacatgctgcttggatctgaaagatctgcttgaagagggtcttccaccactgtgaaccctgaagtcctttccaaacagatggatacacactcacatttgcagaaccagttatacactccttccagactgcgaatcccaaccctctgcccacataaggaaggcacacataacttctttgagtcaatgtaaacacattcccaataattatagaaattaaagcattcctcttgaaacctaatatgctaaattttgttgaacacacagttgctaaaatggagtctccttgtcaggttttaaatgtttctggataagagatttgggtggttttgttttattaataccaaaagcagagaaagaggaaaaaaatcaaagcagattgtatggtcatcataaaatacacgagttcaggccgctgagatgtgtgttttcaatggtttgattaaagactcaaaacaaatgttagaaaaagaactgtaaaagatttaaacaagtgatgaatttaagaaatttcaagaatttttctttttaaatctaaactgttaaattctaaacaaatcaaatttagagtccgttgccctgtgtcaggcagctgttaccgagttggctgtattttgcatctgttatctatcagtggattcgctggattactctgcccttcatcttgcctcaaaggcagcttcagacaaacagtagctgtgcaatccagcaagcggggctgcaggcctctatctcctcacctcccttcctatctagccaacagtcaacctgccagtcattctcccaggcttctagatcatttcctaacaaggtgacaggcattttagttcaactagcactctgtgtaaagtagacacagacacgtctgcccgggacagaatagtatgtagcagaaatctgggtttgaggccagattgagactccactaaatttcactttaaaaccctacaaacagaggctgcaaagacggcccagttggttaagagcactcgttgctcttgcagagaacttaggttctattcccagcacccacacattggcacgcaaccatctataactccagttccagggaatctaactccttcttcttacctctgtgggcaccaggcatacatgtgagacacaagaatcaaatactcatatacactaaataaatacataaatatttttaacttacaaattaaaacctataaatagaaccataagccacaagcaataaactacaaataatatggatattagtgctttgtgtttgtccctgagccaaagcaaaatgatgtacaaccaaaccaagattaagttatgaattcattggatagcactgggcacctctgtcgggaacacacgccatcctcacagcacttcaccatatttcctattatccctacttttaaaagcaggaaagtgagactctatgtaaattaggtcacagctgggatttaaattcagacctgtctccactcactgcttactcctatttcaagattaaaactattgttagaatgtgtgtcaatagctcaaggatatttaagatcccccccaccaaaattttttttgaaaggccctgaaactctgttctctcaggctgacaaaaatagtctggataatttggggcaggggtgactacttactataatctggacttcttgtcagggaaaagaagtacttgcctctataacatcaagaaacagcagcctcaccctcagaacatggtcggcacttaaataagaaacttaacacatctcacgcactgaaataagaggtgacaacataatgaagaaaaggagtatcattttttagaaacaagaaacctctagatttctacagaatgggaatttctcaatcttcatttagcatttacttaaacgcaagggccagccagcacaggtgagcattgcagcctggcagcttcctgtggaggtaagacagacttccttcagtccaggggacatggtcttgaagacaaagtcagcactgtccacagatagcatcttcatgagcaggccagtgcagatcaccacttcctggctggccacagcccactaaacctgctctcagcttgaccccaccccgatcctctgaggcagatgtctgttataatctctgtttgacaaataaggaagcagaagtagacatcgctaagacaatttgtccaaggcactgcagcttgtcaggaggctgagccagggagtctctgcccaggtccttagagagactcagctatgcaaattagtgatctcacatactcttcaaatccctggaagtcaacagaggacttactctacacatagtgacagtcacaaggctcatcacagtctctaggatatctaacattacctgacttctgctcatctttattctccatatccttaactgtgtcatgagctaccaaaacaacaaaaaaacaaaaacaaaacaaaacacaaaacctctcgtatcaaaatgccagcaccacatgttccctccatcttggggacgagtttacatacctgtagccgactatcccacatcatcactgttcttttttgaacaccatggagatggcagaaagaatagccatggaaagtagcaggacagagacatgctcaagccagggttatctggctgtgccaccatcagatgaccttgccagggttccccagggggaaccttctcacttagtatgcccactgctatgctcagtaaggagtgctgttcagttctctgtggctgaaagcattccttagcatcctgcccattagcctctcatactggcttcactgtaaatgcaaagaggcctttattatattctattctgtattattcccaacaattcaaatatctttttaaatggtttattagcctcataaagtctaggctagtctcaaattcactgcacagttgaggctgccctgtacttctgatcctttggccgctcctcccaaatgctaggataataggactgtgtcacccacccggttttatggttttatgccatgttggaaatcaaacccaaaaccttgagaaggaaagcaagcactccaccaagctgcatccacagttccttaagttattgttaacaagtagttttgataatagacttaatctcagtactatcaacgggcagaaggattactgctaaggctatatagtgagactgtgtctcaaaaaagaaatgaaggagggagggaaggagggagggagagaaggatgaaggaggaggaagtaaaagagggaggaaattatctagttatctcctgacttgaaagaaaagttgaatttcaaattttcaaatccacaaagttgctctgaaatttgtctaggcactgcaaagaaaagccatcaattgagaggactgatttaatcaaccactagcctatttccttattatactgtgataaaacaaagagataattatcttaggaatgaaaaacctttcaagcaacaagtggggctctgtgctgtgctcagtgttgcccatggcctcagtgaaggcccagatgagcttatcaaatgtgccaatggcagaaacaagggtgggaggatcagttaaggaagtcagctgggtcaacactgagatgaacctcactatcagtgagagttctgtgctgggatcacgacacctcagtagcatgaaagaggccggaagtgtccagtgtccagctagacactgctacttcggaaaaggacctggagattctaatgcggggagccaaggctggctcaccaaacatgatgcagctgcccagattcagctatgtccctgcaagacagcctcagatcagggaaggtgacaatggcctttcctcctacattaagcagaatcactgcagcgttctgctctattagggacaccacatgctaacaattttcggggctcaattattaggacaatatgcatggtaacaaccctcaacccacactgtgaaggtggggtccctgctggcgtgagacacttgtgggaggatgtgaaagtgctttgcaagcttttgagggatgcttccaggacagagcagagttactacacaatgtcttgggggtcagaactggaaccaaatgagagaattgttgtggggtggttgaagcaattaaaattattagtatctgtttcagtttgctttctcttgctgtaacaaacaccatgaccaaaagcaacttggggaagaagggatttatgtgactttcacttccatgtcacaatccatcattgtcttggaggcaagccaggaacccaaatagaaaccacggagggatgctgcttatggtgttgctccctggatcccatttagctagttttcttatacagcccaggctcaccgacctacagatggtgctgccacagtgggatgggccttcctcatcagtcttcaatcaggacatggccacaggccaatctgattgaggcaattcttcaatggaagttcccctttcccaggtggctccagggtgtgtcatgctgacaacaaaaactaaaatactaacaattaaaaattgttttgtaataactacaactggccaatcatggactgttcctccaccattagccacacttaaggagagtaaccagcatcttttctgttatcagagagtgttcctatacacaacagtccatgatgaagacaatgctgtcctatgctaaacaagaacacccttctgttcttgctgatatttggggactcctgaaagatcccagaaaaagtgatcacaacagatcttttcacagctccccctaattctaaccagggatacaaatcacccatatagatcactactctattttttttctttatttttgtctccaaaaagagattttcctatctctatagatctggctttggggggggagcattgtttgaacagtctaatacagtttctccttcctagctataccaatccacgtggttactcttctgttcttgtatcaaacaccaagaccaaaaacaacttatagaagaaagaattttatagtaagaaaccgaaaccgaaaacgcagtccccctactcactctgaccacgccctcacaagccctcaggtactcttgtagccagcccctaagaaggcgtggctacagcttcccctacagaatttattttggcttatggttccagagagataagagtccatcatggtgagaaaccatggcaccatcctggtgaggaaccatggaaccatcatggtagggaaccatggcagtgaacagcaggggtagaggcaggagcaggaaactgaaagcacaaagcttcaaatgtcccagtgatgtacatcctgcaacaaggctgcacaacctaagcctcccagcagtaaccagctcaaaaacaagattcaaatgtccaagactatgggagagatttctcattcaaactaccactacccaaacagcctctgtaataattttgcaaggaaactatattaaatggagaattttaaacaatgagcatagactactcttccagaggacccagggttcaattcccagcacccacatggaaccatccattccacagttctaagggatctgacactctcttctggcctctgcaggtaccaggcacacatataacacacagtcagacatgtagacaaaacacccatacataaaaaacaattttaaaaattaaaaaaataatgaaacccacatcaaactctaataaactgggttgttgttttgttagattttcaaaacagttatttttgttgtttatattttagaacttagaaaccatgaatctcccaaatctctacaggccaaatgtccttcaggacacttagacccattaggagactctccgcatactttcactttgaatgcaagcagtgactccttgtacaagagctctgctttcattttcagacccagatgctctccatgcagagagaacaaggcagggacttaatgtgtttagattaaatcacccaaaactgagggcaaacaacagtgggctacaggcatccaggacagctttaaaaggctggtgacattacttggtgtttttgtttttggggtcttttttctagtttacttaaaaagtaccaaaactacagcttcaataacacacgtctttctctcatttctttagaaactggaaaaactactgaaatacagttgtcttaagacacacttagcatagaattcttgctggccctattcctagcaacctccactgagcttggtaaactgatcacacactgtgctgctacacatccacaccaaactaatctgccagtgagtgagcagatcagtttccattaacccctctcattcccaagtgagctggacggcatgttccagagtctctttaaatgctttcccaacagaagactgaaaaccagggactagagagatggctcaactgtgaagagcgctggctgctcttccagaggttcagttctcagcacccacatagtggtttgcatctgtaatgcagttctagcggatctgacaccctcttctggtctctgcagagacaccaagtacacacatgatatacagtcagacatgtaggcagactaccaatacacataaaataattaaatgattttaaaattaaaaaaaacatcaagttctaattaactccattgttaagtttttagatttaaaaaaaaaaatgtgtatgtgggcaggtggaagggcttgtgcatgtaactgcaggttcccatggaggccagaaaaggacatcaaattccctgaagcagcatcatgggtgattgtgagcctccctgaccccctgaccctaacatgctgagatctgaattctgtcattgcttggttttaggtaatgtgtccatagggaagatagcaaactagtatctatataagttgaaaactacataaatctatatgaaaagttggctaatcatacctggtggagaggaaattcagagtctagaacatccaaagaacttcaagttttccctagaggaaacacatcacaccacacacacacacacacacacacacacacacacacacaaacacacacacacactttttgcatgagtctggtctttacaaacacactcggtcctgatgggaggaaaagcacacattgggaggggctttatttgtaatgctttcttgtgtgctatttgtcttgaagttaagaactggaagaagaaagagttcccaagcatccagaacagcagcagagtctgtgttctctcagatccttgctctgctcttccttgcctcgccaaatcttttcaggcattctttacagaatcataaaaacatacctcatgtgcaaccactttaaaccaggcatgtgaacaaacacacttcacacccaagaacatctagttttccagatagctacaaactgtctatttcaatagaaaccacccctgaattagcaatgcaggagattatttataacaatctctaaccttaatttcattaaaaaaacaatggattctcttatacagatataggacaatgtttatattcaccatataaagaactgttaagagctattgtgtttatacaaggaggaaaaaataatgcccagtggattaacattctattattacccatgggctcacaactgaagcatatttctcacaagacaatgggacatattaaccctaactggccctaaagatcttcacagaacagagtgttgttctgtgaagagctaccaccaaggaacactaatctctgtacagaaacatctcatccttgtgacctggccttatgagtttcctatcattaagtttaagtgtagatattatgaagacattgaaaattattatatctaatgacatagaacaacacttgcatggtgaaaaacataacaaaaaataggtaagtagcaagtattttgttatagtaggatgtaatgaaatgaaaataaaaaatacacatgattggtttcttaaagcagtggttctcaacctatggctcacaactcctttgggggttgaatgactttttcacaggggtcacctaagactataggaaaacacagatattttttacattacaagtcataaaagtagcaaaattacagttatgaagtacaaatgaaaataattttatggttgtgggcgatcacaacatgaggagttgtattaaagggccacagcattaggaaggttgagaaccactgcaggtttcttggtaattttctgtgtttttctagttttctagactgtccatgcatcacatttataattagaaactaaagctacaaaaatctaaaagagacctacagttgtcctttttaaatttggttttattttgtgtgtgagtgcttggcctgcttgtatgtatgtgcatcacttgcacacctgctggataaggaggccagaagagggtgtctgatctcctggaactggagttatggatggttttgagtcaccaagtgagatcgaatctgagttccttgcaagagtggcaaatattcttaactactaaaccatctctgtagcccctaacagttgactttcagtaactatgaacttgtcttacaatccagcacaccacacctacaggcatttctttaggtatagagcatggtgtgatcttagattagcacacaacctgtgagtgatcacagcagctctcaccatgaccaccagtgatcacagcagctctcaccatgatcaccagtgatcacagcagctctcaccatgaccatcagcaaacgcaaaaatcccttgcagtctccagtgagtaacagacactctgcccagtgtcatgctacccagaatccacaggggcagagaactaaaatgtacaacaacctcatgattctccaacacactgcactgttaaaatgaaattttaatgaccatataacatgattctgctgatatgacatctgagaagattacagattaccagttatgggggcagggcttgagagggagtggccctgactcttgaagatgatgtatatagtctacatctgatggtagtgttgatcatgggacagtaagcatttgtcaaataacaaaactatatactaaaggagtaaattgtgttatattaagttgcacactgataaatatgccttttacaaacaatcaccctttagaaataaaggtatatacccattcagattataccaaggtctatgaaatgcttttccaaaatttccctatggaaaagatctgtgggtcattttttaaaggttatatgaattttacatagtaggcacaggattgtgaaggaatgggacacagatatgaggagtttttgtttgtttcttgtttttgtctttcaagacggggtttctctgtgtaacagtcctagctgttctggaactcactctgtagaccaggctggcctcaaactcacagagatccacctgcctctgcatcccaagtgctggaattaaaggtgtgtgctggcctgatatgaggtttttaaatataggtgtgtacattacacaaaacttggtatcaaacctcggtagaccaccggttgccaggaggggatcttacaggactagagaggaggttcggaagatgaggaccactgactgaaaatgttgactgtcagcccccaagtagaagctccagggtccccacaggagccatgactctggccatcctagcattgccaatttcctctgcctctaccaaagcatttctgtatcaagtcatgcacgactgagtggtcaccaggctgctttggtccatctcattccagacttaagctgctctctatgcctttatggtattataaaagtgtgtctgccagatgatggagatgtaaacagcttctcctcccaatcagtgattttcaccatcctagtgctgcaaccgtttatacagttccccatgttgtggtgacccctaaccataaggctattttcattgctacttcataactgtaattttgctactgttgtgaatcacaatgtaaatatctgtgttttctgatggtcttagttgacccctgtgaaagggtcatttgaccccccaaaggggttgtgatccacagattgagaactactgtcctaaatgaatttgggagcaaggagccttttctggacccaaacgggggacatggttctttcagtttcttttttttcatttcaaagttcatttaaaaaggccacaatttaatccttgtcagaattataaagtcataatgagaacacaaatatgaaaagtagtttgtatagagcaagaaagtgtttttctaaagaaacattctttctaccaatggaaagtttgagacatgttttctatggagagcattcgagagcagcccagacaagtgcaggtataattactgagcagcaaatgaacaatgaacaaccttctgtctgtgcacaccttaaaagaattgtccagcatctggatcagcatctggatctacagatatcataaaacagaagaaaggctgcccagaaaaccaatactcttgaaagagaacaagactgccaattaagatattaaattatttttaaggctttaatcagactatttacacttcagctgggcatagtgtcacacacccatagtctcagtattggaaggtagaagcaggtagaacagagctgaaaggagttgaaggctagccttggctaagcacaaagttcaaggctagatggtgctattttacaccctgcctcaaacaccaaagtcaaaccaaagaaaacaataaataaacaaacaaacaagtaaatggagaagggactgaggaacaaatggagggagggaggaaggaggaacggagggagggagggagggagagagagagggagggagggggaggaacggagggagggagggaggcccatgtttaaaagtggggaataggtgtcctactctaatttacttattaaaccatgttacctgagcctgggggaggggtagctccattggtacagtgcttgttgagaaagcttgttcaggacctgagttcagatactcagacccatataaaatcctgggtgtcatggtgtctgtaatcccagaactagggaggtggagatgggcagatctgtggggcttgctagccagccagcctgctgaaccggtggtctctgggttcagggagagactttgtctcagaaaataaggtggatcctggatgatgaagacacctatcatcaacttctagcctccatgtggatgcctgtgcactcacacaaagtaaaaaataaagtttaaacaaaaacaaccagatcaccaaggaatggctactctaaaagttagccttatttactaatatttatgaataagatatatcctggcccccacacatgtgcacatattgtatatcttcatttctcatgaaatttaaataacgatctatcaaaaactggacatctgtctccttgcttctcaacagggttttctaaatgtcaaactagtaagtttacagcaataaccaaatgcccaacaataaataggagtaaggcaatttacagcagttattttcatgttctacctcaaagcaaagatggtcaccctaaaagatagtgtgtgtgtgtgtgtgtgtgtgtgtgtgtgtgtgtgtgtgaagaaagagatgtgttaaggtggagactcatttgaactacaaaccaaaagcaccggggcacttccttctatgctattcacaccatcctttattttgtcctatactccccaagttatcacttaagcaactgttgactttacacaagccattcatactttctgtgtaccttaaagttgttcaagaccagaggcagccactgagcaaactggaagccagcctgggctatatgacacatgccatttataatatatctctgagccttaacgaggaaaaaatcacacatcctgagtaagtcaagaattagataaacggtttatatacaaacagccaacaagatatcagggtgcagtgcagaaattcaagaacactctttagctcttttcctctttcctttccttctagagagtttttgttatgtagttgcgatgaatcatttctgcaatctcctaaaagaagagttcagctagagacaagctttgatgtccctgaggccatatggacagttatgcacatgacctactaatgaataacttgtcaattagtagtgaacagcaacaaaagacattatctgacgggctcccagatacaattatgtgatatcatgctgtatgctttggcttgcagagaattttccaagttaagacagttccagctccaggttcatgacaggaaccacagctaagcctctgtataccaaggcatctctggcagaaagagactggtgagaacacaattcataaacagttcccaagcaaaggacacaagtttgtaatgaaatcaatctcttcttttgtttgtttgtttttatatatttgaattacaaacaagactgaattacatgatgatcccagttcccttctccctcccttcctcctctcctacccccccactcaaatcctacctgtcatatgtcctttcttctattctacacctgactcaaaatttctgcttcctcatgacctctgcatccttccttttcttccctttgaaaccaatctttaagtgaagtgattctaaactaaaactaaaagtaagatgatgtcaagtagtgctatgaaacgctaccttctggtttgacatggctacagcactcacaaactcccaacgggctagggtcatatatacaatgtcaatccagcaaaaactccagacacagggggaggaggtgcccttcaggccccatctcttaattcagagctattggtaattgacaggtactgggggagaaataatcatgtttgtttgtttgtttgatgtgtggccactggtagatttcccaagttcccaaggataatcccacactcatatacacatagggagaaataattggatttagtagttatcaaaaatccatcaccagaaaacaagaacaaaggacattaagtcaggagaaggccatgttgcaggaaattcagggagccttggagaggagacactggaggaggatatgtttatgtatatggaatacacatatatgtttatgtatatgacatacatgtatagaattctcaagaataaacaaaattaatattttttaactagcctgcccaacaagccaaactcaagctcatcttaaacaaaggcctcacggtgttcaatgtagaagcagttctggaaagaaatgagttctaaagtcacaggccagtagaacaaatccaggttctgtggagtccaggtctgcccccagccccttgcacattcaatgggatctgtagagtgcatcttcttgagtagccagggtttctccagcccacaggagatccaatatataagcagtggctcagaaaaacaatagaagtgacatggccaacatgtgtccacagaggcctggcatgaacatgcagttcccatggacaccagagcagggaaaccatagaaggcagccctgaggcttgacggatccctcaagtccaacaggaaaaaatgaaggtaaaagttaagattcagcaaccgcctgatctccagattcccagaatgcactagagtgggaattatgggcatgaaacttctcatttcagtttacaaaggaatgacaaatggaacaaagctgagcctctcccagtatgaagaaatcttcgaataggcccagtgcagatgaaggtgctgctctgacagaaattgttctggttcccccaaaggctcttcagagcctacagcgccactaaaatggcaacacacaggcgccactggcactgtgatggctatgcattccatgttgttgtttgttgacatcaactttgagacatacttacacacaagtgtttgccttttgtgagaagcagtcagtgagtgggaagaagtctaaacaatggatatctgactctggggtcctggtccaagtgccataagccctctttgtttatttctccaagtctcaaagggagccattcccttccagttccatccatgtcctcagtctctgtcaggtgagacgctcaaaccccagtttcacttcctcacttccacatccctgtctaacgcaccccatccttgcaaaattatctccaaaatctcatgacactcttataaaagggcatctgtgttgagataatcattttgtacactgtgtaaagctatgtctctgtccttcctcacctgcctaaagcaccttctgataggcttaataaagagctgaatggccaatagctaggtaggacttccatgtagagataggaactatgggaagaatctggtgtggatgatttcacctgtaagacatgaggaaatcagatgtatagtacttaggagtggtaaagagccatgtgacagaatgtagattaatataaatgggttaatttaagttttaagagctagttgggaacaagcctaagctttcataaataataaaaagtctccatgtcattatttgagagctggtggtccaaagaaagtccaactacacatctgtgagggttattttttttaagtcttcatacctctgatttcttagggccactgccatattccaagtcattacatctagattaacctttatgtatttttaaaacacattttcattctaaccatttttctgtgagacaactgataggctaaagacagaactgataatgggaactgtaccgcccactgttgagcctgtgtctttccccagtacacagtattctgtggctttactatttaataagtctttgttatgcatttagaatttagaaatataatccccagataaatgagagtagatatgtcccaagtcccagtggtccttttctgggtccaagcagccaacatggtcaggttgttcagagcagcagagagcaatccaggagtgagacagatttggatgctataatatggggaagctgttctggaaccattccaggaggtggcagagcatattacacacatggaggcagaatagcctggggaggagagcagacagctttccccaaccagccacagaaaaagcccaccagaaaaaaagaccagcagtgcatcaacaaatagcgggtcccactaaatgagcaggtggccctgaggactgcaggggttatagggatgaccaccagaccacagatgacaggaagaactgcaggggttacagggatgaccaccagaccacacatgagaggaaggcatgatagcacttgtgcagggtttcagaaaaatgtccccaggaactgagaagtataagcaaagtcagctcagacagcaaccatactctgacatggctgaaagaaagtgaattttacaacccaactagagcaaggatggaggaactcattggggggtaacatgaaaccagagattcccaaccctatacctgccttccccatacatgcagacactgtcctggaaaggagcccaggaggaaggcaaatataggagaggctaagtgttttattaactgaatgaatatacaaaacctgaaggaactgtttctacccctgtatcagaccaccaatatcagaatggactccttttgttatcatcagctacccaatgctcacagcaatcaggagcctcaaatcttgcttagaaaaaaaaaaatgaagaaattacatggcttcttgctcgaaagaaacattaggagatctataatcccactaattagtaaacagaagacaagttccatttccataaagactattttcagtgttgttattatttccatgactgatggcaacagcccttcaccacttctcattgtcaacaagaataagctcacataccagactcttaaaggcttacaactcaaatcgtggcttctcttccccacttcgtgtccaggaaacgctgaactctcttctctctgtatttctcccatctatatggcagtcaataaaatggtaaggagtaatgggcagtcaacaaaaatggaacacaacaggttctcccatgtcattagagtacacaatgctgggctatggcatcattctagtatttcccaaatattatgttgatgtgctctaatgagattagtcagaatgaactacaaggaagagtaaggagagcaaccacaacatcaagaggggaaaaataagagagtataacaaaccaagcaatataaaccattcaggaggtggaaagggaaaaagaaggacaaagtggcttcaggcaagacttacacaatgacagcaaagcaaacacacacaacaatttttgtcaatgcagcagaagccccacagtgacaagttgactatcactaggagctgtaattatggagttatacagtctacagagctaattgccaaatctgagcactcaccaaggtggaggatttttcaaaatctacctatcctcctctgtttcaattctttaagctcaccgactactcaagtaaggaatgtgttctttgttaagtgtgcaaataggtcatgcagcaacagcaatatccttcttccttgtttttctttttccagtgttgggcataaaaccaggggtactatgcacactaagcaagcacagagtcaccaagttatgtccccagccctgtattatcttcacagtgagaaacaaatggaaatgatgaacacaggaagaatagaggcctttagtcacaaaattcacagcctaaacatgaacctcctaagactcacaactcacaaaatttctacttagtatttagcttaactaagcacttctaagccaaaatcaataaactgaagcaaatatgtccccaagtactccttcaaaggaccttaatctctgagcaccagtatgtgtatagacaacctagaaaaacatacactaaaaagtctgaagaatgtcactaagagctgtggcatctgggttggccccataagagagacgtggtgtttccataacaaagcaaacagcaacaaacacaagctgttctgctggccacatgaggatctcgctggggccacagtgctgcccagaaaacacagcttgagcaggactctactgcttggagtaggagacctggttacagcagcaatgggccttctctgcatctagatatgcttaaggcaaaatgacaaacgtaatcaaagccccaccaaaacagctgtgcagtatgtgtaaaatcctacacacaagactaatagtggaaaggggactcggactcaaattcaggctcctgcattggcaaaatggtcaggtctccacatgttccagctcaaaatctatagattcaataaaccagggttgaaaaatactcagcaagaaactgggttgcaacaaacatggatagactttcttcttgtggttattccttaaaaaaatatagtaactatttatgtagcatgcatattgtattaggtattacaagtagatgatataaagcatatggtgggtggtgggtgtgtggtgcatccttacattccatcagggaagcagaaggcacgcaggattgtaagttccagaccagcttcacttacaaagtgagtccaggccagtttaggctacaaagcaagactttgtctccaaatacagagggttagaggtatagctcatggtactgtgcttgcctagcatgcacaaaaccatggactcatgatctaacatgacaacatacacacaatgattatgaaaactatgcagataccacacattgttgtgtaatatgactgaaacattcacagatttggtatctgagaggttgctagaccaatcttgggctaatgaggaagaaccttgtcaattcttacacaaagtaagaattctcagataatacattattactttaggaatgaaatgaattattaggattaatttaggaaataaaggtatttggtgggtggtagcttatcaattaaagagggaaaaacatcactccctaaggagtttttaatttctgtggtagtctgcatgtgaatgaccccatggactcatatttttgactacttggtgcccatttaatggaactttttgagaaggattaagagatgtggccttgttggaggaggtgtgtcactgggggtgggctttgtggtttcaaaggacattttttgagttggttctctctgcctcttacctgcagatcaagatgtatgctctcggatgctcatgccaccatcaccttttcccagccaactgtggactccacccctctgaaactgtaagcccaattaaaggctttctcttataaattgtctccttggtcatgcatcacagcaatacaaaagtaattaagacaatgtcttaagggcacatggatcaaattcaggttactcctcattctgaaagaacatacagtttaaaggagacacaattctcctccttaaaatgaagctgaaaatgtcccgtattataggggagcctactattcttcaggaagggacatcactcaagtgcatggtaaagaactctgattggttcatcacctctcagtcacaggacaagtaaatttctttgtaatgccagcataaactttgtgagattcaacatactctaaaaaactgtctttgaaaatgcaaagccacactacagggctaattgttaaaggctccacgaatggcctggtatccaaagaacagcttactgtgaccactgcacttgggatctgctatccgacacacaacagtgttagaatgtgccctgatccttagtcaaaatccacctttacaataagggatagtttctgaccatcattgatagtagtaaaataacaataataagagaaagctgactgtgttgcaggcctttgccttgggagtctttgttttgtttctttttgtctgaaaggcatccaaactgccttcctatttgaggcactcacccattgtgtgagtcctggtggcaggagagaccctacctcacaatggacatttccttccctggtccctggaagtcatgtaacccaggctcagctcctatccccttccaggcacacaaagaggcagagtccttagagactagtcacagagcttcaggaagccacaatgggagggagtcagtaaagcgccccagtccctgtgccagctctggagccacacttaccctggctgctgcagactctcctatgttcctaaggcagggccttgtatcactcctgcctttgttctcagcctgggcttccagccctcttctgtctgtattatgttctgcctaacgctgcctaactcagacttctattgcttgcagtaaaggatgtgacttcccccaggggagtagtgatttccatctgagccataaagagttaataaaccactgggagcagccacttggtacacaggacaataatgaagtcctcagtaaaggccacatagtctgagaaattctactttctcaacactagcttgtttagaaagaaaaatattcaggtcaaatatttattctatgaaattaatctctaatgatggaaatcgaaactaatgtttactttgggggagtagaaggaatgggagggactgtaaaagagcctgaggatgctggaggagttctgaattttcatcagggcagtagtggaatggacatgcacatttgtaaaaaacactatgtgcagatgtatgcatatggctacatataatttacctaaatgaacacacagacacatggagtcataaacagaaacacataaagaaacaggcccagctgatgatgtccacatgatgtcatggatgatcaggcccttagcaatctttatttatgcacatagtctcctttgaccttggaccttcccaggcattctaatctgatgatagacaagtccacagtggacacatttcaatgctcagcaccctttaaatgtaaggattcaggcattatgctggcctgccccgtcacctggcagaacgcacacaagcagtaccctggtcatcccatggttgtgtagtctgcacacaggtgcaaaggaaacctttaaaagaaagacaccccccccccggccacttatgctctctcttttctgctgttttcccggggcagacaggacttttcctgtctccctcttctcctgtcctctgtctctgtgtgtctgtgtctctctacctcttttctctttccttcatccccccttccctttctaataaaacttctcactaagctctgtctgcttggcatctttgtcccctgcctcggtcaccctcacctgccatggaatctaccaaggttcctcgagagctttatcataacactttggacttgggcatatgatcagttttggtgtcaccgccttttttcacacctccaactttggatcaaacttggtggccccaacatagataagtgatatctgccatctccatggcaccattgaccaatgtttcaaatgcaaactgatttctctgcccttcaaatccttttctacacaaatggccttgaccatctccctaactgatccccaaaataattaaactatgagcccattgctgacacaagcacttgatgtggccagctactaaccactgtcctctttatccacaggaggaaactaagatacttagaagccaaacagcttaacccttgaagacagcttgacctgaagctccccagtcaaccctcctatttacagctaaaatccaagaccagtacatcctctcctcttccttcattctccttgacagtgaagcaatgaactaatgatttctgtttaaagatatccattaacttttttattgcccccttccttccttccttgtattccaataaaacatggctcatgacaaataagcaaggaaagctgcttccatctagaaggtctatattaatccagattccctccttccagacaatagaaaatatttaactcacgatgaaaatttcatggtgactttatacgcaatacatacttagaatgaccaatcctggctgacccccagaatgacactctccattcttcacacttctaagtggtaagcttcacaaacacctcatgaccacatctcaagtagctctactagaaatttctacttgtccagaccccaaccaacaatctggagtgatgctggtaaccctgtttcctctgcttgtgttcagtgtctaccactctctgtacctgcagagtgcacactttaaaactcccaaaagacaaagttaacttgtgtcagtaagaacattgtgtccactgggatctaacactttgttctggatcctcagaaggcagaaaaaaatgagaggaaagaagggaggttggaagtgagagagggaaggagggatataaggaaacgaaggataattgaaaatgctgacataaaaacaagccagagaacgcagctgtcacagaagaatggctggctatgtctctgtggctagaactgacctgtttgtttgcttgggcaatgagtctggcctctaacaaaaccttggtaggaaggttgttttttttcacaattagaatgatagcaatattatcaaatgttttcatatacaaacactctacacagtaatattatttgattcccttagtgttattacatttcctccatttgcaaatgagttaaaagggtatataattatatgtggggatactattacaaatggttaataaagaaatccctctttaaccaatgttcattgcatttatatttacataattgtttccaactgatcaatacacaaagtaatgatctccaagctcaatacaaagttacagtgctatacaactcactgattgccttctgcctcctcttgacagtgaggcaaagaaagtcagcccatgagctgggttatcagcctggaatgcgagtggtggaagcatgcctctaccctaggagctagatgaggcctcttctgtgtacaaagcatgctaagaactcgaggggaaagttcactgagtttgtcttcaacaacttctcactggtcaacaaggcagagctctatgcaagctggggcaagtttgcaggaaacttcagaccctgccctttgcagaagtcaggcaagcattagcaggaccttccatagtcctagtattataggtaccaagccactcaaggagaagaaaaaatccaaaaaatctatgccaagaggcaaagaaaggtgaatagcaataaagatatctacacttgtacctcagtatgagaaaaaaaaagtgacttgtgtccaacagtactattcatcattctctcccctcacatcccacaagccactgtgctcccaggttcttagagagaatccattttttaaaataaaaacagaaccagggtcaaggcaagtaaggttggttgttatgttgtgcacgtaaagacatgttaggcaaacaggctgagtacacagcacagcagtcttaagtgacctcagggtatattattaactctgactgtgaaatccagcaaaagtcccagtctctttgaatgtaggtaacatttttataataatacattgcaacagaagttcaacagaggaaaaatgatcctctcaacagaaggtgatggaacaatggatcacatatattcaaaagacggtttgtacatacctcatgttaaacaaaatttaactccatggcatcatggatttcaatgtgcatacaagactggagggctttgttttgtttttgtttttttttttagaagaaaacaaggagaaaatctgcaggagtccatgtttggcaaaaagtatttagatatagcaccaaagacaggacctataaaaggaaaatttagggccagcaactcagccagtaatggtgcctgttgctaagcctggcggcacaagttcaaaccctgtacccaagaggtgaaggagaaaactgaatcctgagagctgtactctgacctccacactcacattgtagcaactgtaacagttacagacacacaaaatacttgtaatttaaaaataaactcagaaaactagagtcactttaaaaaaaaactgaagaaccatggtgaatgttttgaaaataataagtcacaggtcaagaaaaaaatacttgtaaatcataaacctgaaaagaaacttgtatccaaaatatgtaaagacttttgcaaatcccgtgaaaacaagcaagccactgtaaaatgggggaaagggaaacacatctccacagacatctaatcaaaaaaagcacaggtggcagggatgcccatggcagtgcttgctaccactgataagagaagcacatttgggccacaggaagctgcagccccaactgtcaggatgccaatacagagacccctcaagcaggggttgagccaggcctcaagtcacaaagaaaagaaatcacataataaaatacctgggctttcaacagaggaatatttaaactgtggtatacatataagggttacatatatacaattagaaacaagattgctttacatgtcaatcccagttccctctccctcccctcctcccctactacccctccccaactaaaaccctacctatcacatatcctttctgctccccagggagggtgaggtcttccatagggggtcttcagagtctgtcatatcttttgggatagagcctaggtccacccccgtgtgtcttggctcagggagtatccctctatgtggaatgggctcccaaagtccacacctatgctagggataatctacaagaggtcctggagatttctgaggtctcttcactgaaacccacattcctggggtctcgatcctggataccatgttggtatcccagctatcagtctggggaccaagagctcctcgtggttcaggtcagctgtttctgtgggtttcaccagcctagtctggacccctttgctcatcactcgtccttctctgcgactggattccagttcagttcagtgattagttgtgggtgtctgcttctacttccaccagctgctggatgaaggctataagatggcatataagtcagtgcagaattctaccagaaattcaaggaacagctaataccaactctcctcaaagtattccacacaatagaagcagaagagtcattgccaaactctttttatgaggcttcaataaccttgatacccaagccacacaaagacacaactaagaaagagaactacagaccatatccctcatgaacattgatgcaaaaatactcaataaaatactggcaaatcgaatccaagaacacatcagagaaatcatccaccatgatcaagtaggctttatccagggatgcagggatggttcaacatatgaaaatccatcaatgtaatccacaatataaacagactgagggaaaaaaaccacatgatcatctcactagatgccgaaaaagcctttgacaaaatccaacaccccttcatgataaaggtcttggagagatcagggataacaggaacatacctcaacataatagaagcaaaatacagcaagccgacagccaacatcaaattaaatggagagaaactcaatgcaattcctctaaaatcagggacaagacaaggccgtacactctctctatatctctccaatattgtccttgaagttctagctagagcaataagacaacaaaaggagatgaagggaatacaaatcggaaaggaagaagtcaaactttcactatttgcagatgatatgatagtctacatgagtgacccacaagaagtgttactcttaagtgacataaaccaacagcgctctctctctcctctctctctctctctctctctctctctctctctcgtgtgtgtgtgtgtgtgtgtgtgtgtgtgtgtgtgtcttgtgggcgcgtgcacgtgaatgggcacacgcacactaacctcaaatacattttgacaagtgtaagaagccatactcataaaggctacatattatatgacttggcacataatacagtctttaaaaatgaagactatggaaagaaaaacaggcagtggtggcacatgccttcaatcccagcacttggaagacaggggcaagtgaatctctaagttcaaggacagcctggtctacagagtgagttcctggaaagccaagggctacacaaagaaaccctgtcttgaaaaccaaaaataaagaaaataatgaaaaaagaagaaaaaagaaaaacagaatagcacttcttgggcattggagacaggaaaagggtttgactgcaatagactagtacaagaaaaccagagagcagatggaatcacttggtgcgaggctgtttttgccaaatcctacagaactctagaatacagaaagcttattttagtgtatataattaaaatgaaaccatccaggactgtgggagaacccagggtttaacacagacagtagcactgaagccaactgtatttcaaatgtatgtcatgagcacttggaaagaagtgtagaagaagggagctgacctcagccactgtgttctgactgaaaagcagagaagtgctgggtgtgcattgtgatctaatagtaaagtctacattcccacgggggtccaggtcagcaatactataaactacttaacaagcaaagtgctgggaaaaaatgatcaaatgcactgtagataatgacagcccagagtttcactgtcagagaaaatattttaaagaataaataccagaagggactctgcaggactggagttaggaaaacattcctaccaatggctaaacgatgtatcaccaactgctatttcccagagatataccgattgtttttgtttccagaaagaggaaggaaaaaaaacctctttgtttttgtttatttcattattcaattgacgtggtatatgattggggcggggttagggaaagttattctccaaagaaaataaaacatgctttatgtcaaaaccaactttatatggccagacatagagttaatatatacctgaagtcccagccacttgtgccattgaggcaggaggctggcttgaactgtcaggggtctagcataaactgcccaagacagcaaaaccccatctcaaaaatcaaaaacaaaatctatcatttttcaaataaaaaaattataaaatccatgagccagcctcaccattctagtcaggggtggctaaactgaggtgaacatatgagtctgctgagcaaacatgacaaagtttatatatgctatgggaattccccgatttctgctcagagtcagttctaagggcacctgatagaactccacaggcagcccaaggtccagcctccttctattccacgctacgaatgccacttcctggaaagaggcagaccgaatatcctcaccaaaatctcaagtggccaaaccacagtcacctgctaatctcctgccactgtttctttatacggttgacagatgtacacccacactatagccacagagcaaaagcgccctccacatcgcagacttctccatctgctgcctctccactctggtctagtcatagaaagctataatacaagatgagactaaccaggaaggacaaggccccagaaagctatcaccttcaaagtccagctccagccaagggcttatgtagagtgaagcatgaatgttgccctgggagggacaacagggaaatccagacatccccagcagaggacccaggccaacagggagtgccagttctcataaaacagggcttcaagataccaggccaggatcctaactcaggcaccaatttgcatagaggagaggactgtgaaccccagaataaacttacctttgaggccctcacaggacacacacccctattcactcaagtcaagggtcccacccacacatcacttatgagcatgcccacaaattcttatttgctggtagcaggcagaagcagcaaagagaggaaaagtgacagagaggagaagaggggaaactataggatgttgtgtgcaccacagcatcttgactcctcttcatggtcacttctagactcaccagggacacacgtgagagggaactcttcagactttttaacggatctagaccttctgtgaaagctgcaaacctaagactaaatgttaccttcctgaaggtgattcttatccaaggcctcagttgctttcccacctactcattcctcccctgcctccagtaaccactgtctggctccctacttctttgagtttgactttgagacatcacaaggccatgaaaccttatagtgttcatctctctgcctggtttgtgttgcttgcttggctttcttttcttttctttctttctttctttctttctttctttttttttttttttgatttttaaggcttaatggttttctataccacatttttaaatccacttatctattgatgggcacttggctcttttcttatctttctgttgtaagcagtgtagcaatgaacaaggcagccggcatcccctcttcccagcatactgatttttcagcccctaactcagtgggattgcacacacacaaataaacaaataaatatatgtctgtttagttatttatttattatagtcatcctttaggtagttccagaagattcattggtcaataagtagatcctccaagcctttaccatcataagaaccacatagaagcatttacttatctaccctgggagtaacacagtcttcctcaacctaccagcctcaccaaactatgtatcttagatgactcccaacctgcaattacaccccaacacactcacattgtagcatggttttgttgtttgtagaaagtaattcagtgtgatttgaagagggtgggagtttaatgtcctctataaatggtcagtagtcatctcccagagaaagggagagagggagagactagctcactgacttctgggagaggacaaaattctaaagactgaaattcatgaactaaatattagaagcaaaagaggactgtgacttgaaggtggcagatgacactatggacatagattaaattagtgtcctctgcagtcaccttccctctcctcccctccacagggactcctggggctggaagctccaggatctgtgagctgcatttccttcccacaggaaactgctaaattttctcctgtggcaaaggccttttgggactgcaagattcctctctaaacatctaagacagatcctaaggggaggatcagagaactctgaatccaataaataaataaataaataaataaataaacaaataaataaataatctctgggttagattttcaaggcactgtaaaacctggttttctcttcatcaggcaatttgactaaatgccacaaacttagccataaaatgagcagtctgccctgcctgctcaagcttcccctgagatgttttctgaagggtgactgggtttacaacagccatcagctctgcaaagctctgctctgtacaccagcttcccagatggactcaaatgacaataaatgtatatgttgatgtacacacagatacacagtggattcaacctgaagaacggtacatcccatccaacctggctcagagtgcatgtagctgactgcactcaccatataattctggtatcccaaatcattatctaaatctacacagtgatgataaaagactctccaccgtatcacaggaataaccgtgtaacactaacatcaccctgagtgagtgcaaactcaggtcatgatgtgagtagtttgagaacttcatccctgccctctggacaagatcagtgtacaaagctttaaggagctttagtgagaatgccccatgctaaggatgcccatctgcaatagggtcatcaaaatccacaccacaacacttctcacccatcaggacatcttcattcagaacaaaatacaaacataaaactggtgttggtgggacatggagaaaataggattcctttgtactgccagtggagtgtgaacccacacagctgctgtggggaacaatctggcgagtcttcaaacagctaagcattgagtttccacgtgaatgagcaattctacttctaggtatctgctcaaaacactgaaagcaaggactggaacaaatcttcgtacatcagtggctttagagtaaccaagtacacagggattaaaaagtagaatggtcgctcccatgggctgggggggactttacgaatgttgttggtgcttaatggatgaggagttccagacggagaagaggagaaagtctcagagatggatggatgcacaaccatgtgaatgcacttacggccactaaactatgctcaaatgggctcaaatggggcccatggggatggcctaattggtaaagtgttgggcacacaagaataaggacccaagttcagattcctagcatccatgtagaaaagataggtatatctatataatcccagaagaaggattataggcatacacaggaggcaacagagagatttgggggaggagtgttgctggctgttgaatctagcagaaacagcaagcccaaggtacagaaagagaaggagactctgtctcaaaaaacataatgaaatgtgacagaaaataacaccgatgtcagcctccagcctcctctacacatacatgtgtatacataccatgcacacacacaaacatgtacacatgcatacatctcacacataacacaaatggctaaaatgttgtttgactacagaagatccatcagaataacaaagcaaatatttttgggtttttttagactctattctatcttcacaaggatgcagagaaatgggatctctcaaatacacactgctgacaagaagcaaaatgctaagacccgtccccctggaaaatatctggccatgcctttaagagagtaagcatatggtcacacaaaccagcaaacatactcctgcagatagatgacagagttgcaggttacatctgagcaaaagttgatataaagccaaccattgcagctttatgtataatacccaaaacctgcaagcaaccaaatgtcgtgatgatacaaacttattccacaaaactctatttagcaaaaagaaaaaaaaaaagtgtggctacctccatcacattggctacctcttgtgagcatcatattagatgagaaagaagtctcaaaagatcacatgttgtatgattccatgctatataaaattctcaagcagggcaggttggcttgcacctttaatctcagcacttgggaagcagagacaggcagatctctatgagtctgaggccagtctgaacacattgtgagtttccagaccagccatggaaaccctgtctcaaaacgaattctcagaacaaggaaattacagccatgaagatgactgctagcatttatgaatggtggaagaaaagtagggagatacccaaatatatcatagtttatctactcattgatgaaagatactgacaactgtcctccatcaaaagtttccaaatcccacattcccattcattaacacaggaccacatctgctcacttcagcctccactggaaacacaaagagactcccacaaacctgtcactttcaatcccaaactgacatggaagtgatggggaatgtaccgtatatgttcatcttatcgattattgaataaaatactgtttggccaatgagacagcaagttaggcaggactaggagccaaagaggattctgggaaatgtattagaaaagtggtgatccaggccggaagagacatagcaaggagactcatatttagcaaggaaaaacaggaactgtcccttttcccctttgcctcctccagcagcaggatgtgagccaccagcaaggagggacgccaataaggcttccgataagttaaatctaataaaatatatagatttatgataattaagactgagctaacagatgagaagtcctagtcattggccaagcagcattgtacctaatacaagtctctctgtgcattaattggggccttaattcgggtgggtggctggcataaagcgcacatgtggcggtggggctcgggcggcttttggtggaaagatttatcgtaacatggaagtaattctcggagaagataacatcagtctttgacatggtgtacatatccaactggttctacattctcctgccttacctactccaaccaaaaaagtcattcttaaaactccctttcccattcgttctcctgctccttctccttctccctcctctccttctagtccttctcctgcccatcttctctctctctctctctctctctctctctctctctctctctcctcccactccatctccctctcctattctccaccccttctctcactccctgtcactctttttctgctcctacttcctctccctcttcccctcctcctctggaaaagaaattgtggctgcctagtaagtctaagaatttgaagaatacagcacatcacagaacttgctacaggaggacccaggtatagtaggtacaggaggacccaggtacagtaagtacaggagacctatttcatcattactccaccctgggacagcaggaggcataatggattatttcatctaagatccttgcttccctacagtcctctggcccagtcaacacatataccctccctcagcctcaccatctccttggaaatttttcctgaggttcactagttaactaaagccagccctatacaagctcctctgagaggcaccccctaaacttgctgttgtttcagaagcaaattcagtatgtgtctatccagccctttgtcacagtgatcatcactaacattctcagtaatgaatccctaattgttaagtctctatggaaggacccctttttcccttcctctgtaaagctagaatcccaaagggacagtcaccaaactgcaggaatgaagtcttggggatctggtctgtaattccaaacgctggggaggaacctgcacaaagtatctacaactgtcatttttcttggtctgcaacaataagcagcttccagaatagaaccacaattgacctgcacaaggctggggttgccaccagatgccatcagaagacaacacgtgatggtgggaaattagcttgttacctggtatttgttcagagtgttcagtgagaattacattacaggaaaaatttaaattattctctgaggtggttcgggtggtgggggcagggtaggagttgacatttcaactgcaattagtaatgtttgcttcctctccatgcacttcccttcagacactccccttcctgctgagtggccctggaatgtctgagggcatgtcaatacctaggccagaagcaactgaattaggacttttaacctatggaatttgccagccttcataatttctaatttctcactataattactcactttttatctagtcttgtatttataatttcattctcctttctgaaagagcccttcaagaggtccaggctcataatctgtccccacctataattcactaagtacctggcacacagaatctatccagtgaattaatggaagcaccaatgtcaagtcaaatcacttagcatcactgacaataatgagtcacctgagattctagagaaatagttaacaagaaaacatattgtaagataccacacaataccctaaaccggcaaagcagcagctcttttttttttttttttttttgcagggctgtgcaccagaatggctatgaatactgggagatattactgaagaacattagaagctgttgttatttgaagtgcacatgggggctcaacagaaggctcagcagttaatgtctccggtcttccttgaatccacaatgagctgcttatagctgcctgaaactccagccccagaggatctgacaccctcttctgacccctgcaggtgcctacatacatgtgatgtatgtacataggcacacgcgtgcacacacacacattttaaaaaatctttctttcaagtgcatgtggcatggttcatggagactcttccttgagtccggggattctgcaagaatcccttaggttaggggagatcccgggcctgcaacttcaacaggacattctctgtcatgaaacagtcctcaacaaggctctgtcgacctcacataatgtatgcacacaatggccagatgtagtcaagtctcaaatctgggccatgtttctcccaaccatcaggtttgctgacacttatgattacagccccctcttaactgactcccccaactctttctgtgtacccagaatacaaaagtaaataaagacaatgactgccttgtcccaaacaatgatgctctcatacctactacgggaagccagaaagagagagaaagatgcaagaataacaatgcaatagtgctctagagccccagtcagggctctgtgggtgaggatacttcccaaaaggctgaatttaatcccaagaccccaggaggtagaaagagagaactgaccccagcaagagttcctttggcctccacacatgctgtggctcaagcacatacaaataaataagcaagtaaatgttgaaaacacttaagcatactctaggactagcctcggtcactatatatggatggaatgggctaaacttaaatcatttattacttaagtactgagcactgaattagtactgagaaatctgggtaccaaatcatttaaattctgccgtttggatgctttcccatttagcagataagaaattaaatgaaatgataacagcaaactccttcaaaacgtaaagctactttatgtctagaggacttcgctgaagatatgacattttagctgaaacattcatggaataaacttagctacacaaaaggacagaagcaggagtatgcccagaaaggaagcaggcacacagaggtcctaagattgaaagaaacagcatttgagagaaactgagaaaacactgtatggctagagcttctaatatgtgggctttctaccatcccacctgtatgatcaaaagccatttgaatcagcagcagctattgaaccaactggacccccacccagggacaccagcatccctcaaatggccttatagaaagtcagggggcatgcttgcttctcttccatcaacattcacagagagactacattgaataccacatcaggatatgttgaagggaaatggagggacttggataaagccctgggaacaagagaatggagacagaatgaagccagcctcggacaggctaagagaggacttgtctaaccagaacagagagagattttgaatgcagcaggagaggtgaacacaggccaagagcctgtgttctggggatggggtgaaatagagtcatcacaaaatagaagaaaatggaaactctgcaggggccaaagcaacaatccaaaagtgaattaggatcactgtcaggacagaaagaggcagtcccagtagcaggaggccataaggatgtgtcaactgcaggacataagaagactcagaaaaaaaaaaaagtggttttcgcgtgggatgcttgagagactggtgctcagcaatgaaaatcaggaagctgtaagggggctgctttagagaaacttgaaaagtgctttaaaaaatatcaccatctgggttttaagtcaaggatggataactaagcgataatggcaaacagactgtgtggaaaaagaagaggcggccacagcagagggcagggcaagaaggccacatgtgggtgtattcaaggagaagtcacaatagaataggagcagatgagctggcctagaagaagagagaggactttggagaaagccatgcagctggagcaggaaacacagctgatgcacagccctgggacactggcaagggagtggcaggaggtcagggaccccaacgggtccacttttcagtataaatcagaacacacaaatcctctgtggagcccacactctcactttctgtattactccacaactccagttactcttgacctggccccgcccacctgtcacctgccttctcccacacaaagtgcccaccactagcccctctaatataggaagttcctgcactctcctgggcggggcctttgtgccatctgacccccccattaggacactctagtcacacacctatgtgtacgtgtatgtacacatgcagagacacacaccattcattctccaacacagcaacacgctgctctagcacagccttgagctgctctaacacatatcatgacttgaattctcacttttgtttgtctgcattcccccattttctaaaaagaccagaggaaggtaagggtctgggacctctttcctccatctctgatattacagtgcatggagccaaatgaagacttaagaggaaggagaaaaagcagcttaaagaaaagaaaaaatgtgtgacctttctaagattggctttgatccaacaagatgcctaaagccggactgcaaaaagttgtggagaagaagccttaagacaaaaacttctctaaatcacacacacctgggggctaaggagacacataggtgcaccggtgtgaccatgccctccagaaaagctgatttttctagaatacctaaataaaacactttgaccaggtcacatttcagttcttctaccaaggttctcactgtggagactcaaaccctcaggcctgaaatatccccttagatggggtttatgtttacaaatgaaatgtaaaagccaaatggctaggccagcaagatggcccatcgggtacaggcatctgccatcaagcctgatgacctgagttccaccttggaaacccacatagtggaagtaggtagccaactcctgcaagttgtactctgacttgcatatgtgcacatggcatgtgccctcatccccatgtatgtacacaggaatgcacatacatataaaaaaaggtaatcaaatgtaacaaaaaaatcaagtcagttacttcggaattttttattgaaaacacaaaggtgtacattacccaaacttgtgagagggtcactgaaataagggaaacagagtggtgcagacttgagaacactaggtatttatagaccccaaagcttttcaggcatggcagggatgggcagggtggctgctggccaggcaaggtaaatagtccccctgctgtgtgcctacaacatgcaaagcaagcaaatgaaaagggaaagagaatttttaaaaagtaggccaaacagagagagtgggggaaagctcagttaagctgagaacaagagctcctcacagcaggccagcttcagcaagcctggcttaaacaacactggcagagacttccagcagctggcaatgggtgggaggatgctggagtgcctgtgtctaagtcaagatacagcatcacagacacattgcagagaacaaagttgcacaaagcaaacctgtggcccagaagttgactctaggagagacccttcctgattccactctctaagccatttgaaaagacaccatggcccatacaccctgacccctacatacttccccttcaggctttccccagaagccagtgaggacagtgaagagaagtgcccagaagtgacactgtgttcagagccctgtttattttagaatttgtatagaggtgaagctaatggaggggctctatcaggtttctaagtcaaagcttttgctagagtttgccagtggatctctattaaactatgcttctgggatatcagatcacagttaatgcatgtgggtttttgtgagcaaaggaactctcaaaggtcaggacttgcctggatgtagttaccactacccttgagagaaaataaaagagagagagagactttttttgtttggttggtttttttgtttgtttgtttgtttgtttgtttttcaagacaggtttttctctgtgtagctttggagcctatcctggcactcgaactcacagagatctgcctgcctctgcctcccgagtgctgggattaaaggtgtgcgccaccaacgcccagcaaaagtgagacattttaatgaccaaaaaaatgctgatattttcatactgtgaggttcaaggaagacagcagagcaggaatggcccaaacagcaccctttagtggccaagaaattggagttctagtgactgagcaatgggcacagtcactgtaatttatcaaccactaaggtggggaaaccccaaattcattgagggatctgccattaacaagtactaagcaaatatatactgtggtttttaacgcagaatctgtgaaggcaatgcacagagacaaaatggcagagtcaacatggcaaagcaaatcactcagtgtaggagctttaattcgtcatcagcaaagtgacagagactggtcaaaaacttccaaggtgtccttacaaacactaccccatgatgtggtcaagcaagaccagtcaggagtcgggggtgttaagggtcatgagaggctagtcatggggcatgcagagctacagacagagaaagagcaggcctcaggacaggatttccttcagcaggaaccagaagttggtgggcctctgtgggagtccggaaggagatgtctgtctggtgataccagaacaaagccaccaagtcacttactgcctcaataggaagcatcttcccagagctaggaaatggccctggaactcaaacagtccaaccagacaacctgggacctgtcctcagacccccaacagaaggcaaagacccagggagtgtgttcagtcaaatataatatacatgacatccataagctagaagatccagactgtcagaaagactgatggaggaggatttagctcggtcacctaaagcatggattatagattacaacttcatttaggacactgaatgatcccagaacaaccagcatccctcagtaggatactgaatgcccataaaataataatataaatataacatgcaataggaatagaagattaacagatcgaattgacaatgagctactgaaaaaactccactgtccaaccaaccagctgtatgcgacctgcagccctagagagaaatgatggcatccttctcagcaaagtccaccagtacaaaatgtcagaaagggagctggcagcatgagtccacaagcaaaaattcacaagtgcacctctggagatgctgcaaaaaaaaatctccgtgcattggccagagctagagaaagggcagaattgaagttttgtcttcttataaatgtgaggttaattttttttaacatactgctttgaaaaatgtacttcatcctcctcctactggtctcctactataaaaatggaactattgaatagtcaatcagtgccactctagacatataccagaaggtaaattagcacacagcaaagacacctgcccaccatgtttatgtggcagtatcacaacagtcaagaaacagtaccagcttaggttccaagtaacatggatacattttttaaatgtggtaggcattaaaatggagcaatattcagccatgaagaagaacaaaattacatcttttgcagaataaaactggaagtcaatatattaggtaaagtacactagactcggaaaaacagatattcatattttctctcttgtactgagattagtatttaaagagttaaaggagtcttcagccagaaaataaatactgtaggttggctgccaggcttcttctaatttatatctttccaagcttacacattcctgagactcacctctgctagcttgaaacccaccacaccacaatacccactgatgattcaagatgaacatgactacagcagagaacaaagagcctggctttgcagacctgtggcttggggtccagacccatggatgaatgaagctgctccaagactgcaaagaggatgcaatgtcgacttcccaacactgagcaaatcagttattggagatgctcaccccactgccagtcttgccatcatgctgctcctcagacctgaccatggtctgtttttattttctcacaataggggttcagtggaccatcctgctttactgcatttaaaaactagaatgagtccatggttaagcttaggaatatcctgacatccctaagagtagggcaaagccttcttcctaaagataagcaaacagaaacaacccccaaagtctgtaacaaacaacacaacagcatccatattcccttctgaaattgattcctagtagaacaagaaaacaattctacgtcctttctttgtgcttaaaagaaaatacaaaagattacctctttagagttgtggacacaaggaggccagcataacatgaaaatgctacatagaaactaaaaataatagaagctaaaattatgctggcacgaagtaaaaaaagagaaactagacacaacaaaaacataattaagttgaaaacatgcttccaaatttcagctcccatctccccaaaagacaaaacaaaagacaaatctagtccctagattgtttcataatgaaaaggaaaaaacaaaaataaaaccaaaaaacccaatagtggaagacacaaaagaagaaagtcttaaaaataaaaataaaaaaagttttcttcatggatccaaacaaagtaatggggaatttcaagtatatatttatatccacagataatctgtagttataaaaaaaaattctctaccatctttagaaagagttctccatagtgataccaaaatagaaacaccggggcattttaaccataaggacatcataagaactcattcaaacaactcccaggcaaaggaatcagaaattccttgtaagacccacttggatgagatgcttctttctctgagttccaagtagaggtggggaaatagtttccaccaacattttgccctctggaattattaaattatccagatgatctaattctcttggaggtaaatctcataaattagtttatttttaaaaagactcttgcagtgactaaaagttaaatttttattttaaaaatactaatgcctgtaaaaaagggaattagaaaaaaaaaacaggctttaggaaaataaaaattatataatattattgtgtcacttaagacaatatcctgatctgttatgagttcttcacaattcatgaagtttaccagggttattttccaaaagaaccaattaaaacaacagagaatgtcaaaactccattaaagcatcaaaatacatagataggatgcctcacagtcaacagaccaacactacaacactgaaataagtgctgaaagaactcgtgatcagattcaacacagatacagatggacccctggaagaacacacatcaaactgtcagcgaggcttagaactcatgatgagattaaacaccaggcttccaatttgtttggcttactctagttctaattgtgcagtgtgtgtacaaaacacaacacatgtgaattaaaaaatattaagggtttgtataccaaaatacagtgaactgtaagaaaccagacatgaagacattcaccccttgacatccatggtgcacaggtttcaggaccaattgtagatgccaaaatccacagatgctcaactactttacataaaatggcatagcatttgagcatttgcatattacccccatattatcctcctgggtactgtcaatcatctctagatttttttaataactaatttaacacaaacactatggacatagtggctatgctttattttgcagggaagaaaggcaagagaaagctctgcataagtacaaaacagatacaatttttcctataaatatttatgataactgtatttacaaacatataatgaaagaccagtgatgagatgatatattatttatgatttattaaagcttgcctgaggattcagaaagcaaagtcagccactagctatagagatcaggcaatggttgtgcacacctttaatcccaggaccaaggtaaatagtccccctgctgtgtgcctacaacatgcaaagcaagcaaatgaaaagggaaagagaatttttaaaaagtaggccaaacagagagagtgggggaaagctcagttaagctgagaacaagagctcctcacagcaggccagcttcagcaagcctggcttaaacaacactggcagagacttccagcagatggcaattgctgggaggaggctgggggacacgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgaggacagtgaagagaagtgcccagaagtgacactgtgttcagagccctgtttattttagaatttgtatagaggtgaagctaatggaggggctctatcaggtttctaagtcaaagcttttgctagagtttgccagtggatctctattaaactatgcttctgggatatcagatcacagttaatgcatgtgggtttttgtgagcaaaggaactctcaaaggtcaggacttgcctggatgtagttaccactacccttgagagaaaataaaagagagagagagactttttttgtttggttggtttttttgtttgtttgtttgtttgtttgtttttcaagacaggtttttctctgtgtagctttggagcctatcctggcactcgaactcacagagatctgcctgcctctgcctcccgagtgctgggattaaaggtgtgcgccaccaacgcccagcaaaagtgagacattttaatgaccaaaaaaatgctgatattttcatactgtgaggttcaaggaagacagcagagcaggaatggcccaaacagcaccctttagtggccaagaaattggagttctagtgactgagcaatgggcacagtcactgtaatttatcaaccactaaggtggggaaaccccaaattcattgagggatctgccattaacaagtactaagcaaatatatactgtggtttttaacgcagaatctgtgaaggcaatgcacagagacaaaatggcagagtcaacatggcaaagcaaatcactcagtgtaggagctttaattcgtcatcagcaaagtgacagagactggtcaaaaacttccaaggtgtccttacaaacactaccccatgatgtggtcaagcaagaccagtcaggagtcgggggtgttaagggtcatgagaggctagtcatggggcatgcagagctacagacagagaaagagcaggcctcaggacaggatttccttcagcaggaaccagaagttggtgggcctctgtgggagtccggaaggagatgtctgtctggtgataccagaacaaagccaccaagtcacttactgcctcaataggaagcatcttcccagagctaggaaatggccctggaactcaaacagtccaaccagacaacctgggacctgtcctcagacccccaacagaaggcaaagacccagggagtgtgttcagtcaaatataatatacatgacatccataagctagaagatccagactgtcagaaagactgatggaggaggatttagctcggtcacctaaagcatggattatagattacaacttcatttaggacactgaatgatcccagaacaaccagcatccctcagtaggatactgaatgcccataaaataataatataaatataacatgcaataggaatagaagattaacagatcgaattgacaatgagctactgaaaaaactccactgtccaaccaaccagctgtatgcgacctgcagccctagagagaaatgatggcatccttctcagcaaagtccaccagtacaaaatgtcagaaagggagctggcagcatgagtccacaagcaaaaattcacaagtgcacctctggagatgctgcaaaaaaaaatctccgtgcattggccagagctagagaaagggcagaattgaagttttgtcttcttataaatgtgaggttaattttttttaacatactgctttgaaaaatgtacttcatcctcctcctactggtctcctactataaaaatggaactattgaatagtcaatcagtgccactctagacatataccagaaggtaaattagcacacagcaaagacacctgcccaccatgtttatgtggcagtatcacaacagtcaagaaacagtaccagcttaggttccaagtaacatggatacattttttaaatgtggtaggcattaaaatggagcaatattcagccatgaagaagaacaaaattacatcttttgcagaataaaactggaagtcaatatattaggtaaagtacactagactcggaaaaacagatattcatattttctctcttgtactgagattagtatttaaagagttaaaggagtcttcagccagaaaataaatactgtaggttggctgccaggcttcttctaatttatatctttccaagcttacacattcctgagactcacctctgctagcttgaaacccaccacaccacaatacccactgatgattcaagatgaacatgactacagcagagaacaaagagcctggctttgcagacctgtggcttggggtccagacccatggatgaatgaagctgctccaagactgcaaagaggatgcaatgtcgacttcccaacactgagcaaatcagttattggagatgctcaccccactgccagtcttgccatcatgctgctcctcagacctgaccatggtctgtttttattttctcacaataggggttcagtggaccatcctgctttactgcatttaaaaactagaatgagtccatggttaagcttaggaatatcctgacatccctaagagtagggcaaagccttcttcctaaagataagcaaacagaaacaacccccaaagtctgtaacaaacaacacaacagcatccatattcccttctgaaattgattcctagtagaacaagaaaacaattctacgtcctttctttgtgcttaaaagaaaatacaaaagattacctctttagagttgtggacacaaggaggccagcataacatgaaaatgctacatagaaactaaaaataatagaagctaaaattatgctggcacgaagtaaaaaaagagaaactagacacaacaaaaacataattaagttgaaaacatgcttccaaatttcagctcccatctccccaaaagacaaaacaaaagacaaatctagtccctagattgtttcataatgaaaaggaaaaaacaaaaataaaaccaaaaaacccaatagtggaagacacaaaagaagaaagtcttaaaaataaaaataaaaaaagttttcttcatggatccaaacaaagtaatggggaatttcaagtatatatttatatccacagataatctgtagttataaaaaaaaattctctaccatctttagaaagagttctccatagtgataccaaaatagaaacaccggggcattttaaccataaggacatcataagaactcattcaaacaactcccaggcaaaggaatcagaaattccttgtaagacccacttggatgagatgcttctttctctgagttccaagtagaggtggggaaatagtttccaccaacattttgccctctggaattattaaattatccagatgatctaattctcttggaggtaaatctcataaattagtttatttttaaaaagactcttgcagtgactaaaagttaaatttttattttaaaaatactaatgcctgtaaaaaagggaattagaaaaaaaaaacaggctttaggaaaataaaaattatataatattattgtgtcacttaagacaatatcctgatctgttatgagttcttcacaattcatgaagtttaccagggttattttccaaaagaaccaattaaaacaacagagaatgtcaaaactccattaaagcatcaaaatacatagataggatgcctcacagtcaacagaccaacactacaacactgaaataagtgctgaaagaactcgtgatcagattcaacacagatacagatggacccctggaagaacacacatcaaactgtcagcgaggcttagaactcatgatgagattaaacaccaggcttccaatttgtttggcttactctagttctaattgtgcagtgtgtgtacaaaacacaacacatgtgaattaaaaaatattaagggtttgtataccaaaatacagtgaactgtaagaaaccagacatgaagacattcaccccttgacatccatggtgcacaggtttcaggaccaattgtagatgccaaaatccacagatgctcaactactttacataaaatggcatagcatttgagcatttgcatattacccccatattatcctcctgggtactgtcaatcatctctagatttttttaataactaatttaacacaaacactatggacatagtggctatgctttattttgcagggaagaaaggcaagagaaagctctgcataagtacaaaacagatacaatttttcctataaatatttatgataactgtatttacaaacatataatgaaagaccagtgatgagatgatatattatttatgatttattaaagcttgcctgaggattcagaaagcaaagtcagccactagctatagagatcaggcaatggttgtgcacacctttaatcccaggactcaggattaaaaggtaaatagatctctgttagtgcaaggccaccatggcctacacaaaagtgaagagtaacagagctcatacctttgatcctagcacctgggatcacacacttttaatcccagcattatagaggtatataagacaggagcaaggtctcagagctgtcattcagcctcaggattctccagccacattgaggacagaatagcaatctgagattacagtacgaggtttggtggagccaggatcaccttttggtctgaggcaggggtaagagctagtgcttttctgatcttatgcttgaagcttgaaccccaataacagtctctgaggcttttatttatcatgttataacaagacgctccccaaaatacagaacaaacggtagcacaggttctttgtctgtacccatgcattttgtgcatttgctgggacttggtttaagagtggtttccattgtaacatatgctactgactttttattggcagaggccaagtagccacattggcttaagtcagtctgcaataatttgacatacaatattaagtgaaaatggcaagacacatcatagatatgtagttatagacagagatatgaagagtcatccatattaaatatatttaacgcttttcacctaatctaggacaccatcagttacaatatacattttatattctactatgaatgccatgttttattacatggaactacatagtcattaaatgagtccttcaaaaactaatttatgcacagattttaacatgtatcacagatatctttccatgtctttctgtgtacacaacagctttgtcttctaatgccagttcatttttaaatcaattattccatgcagtatacactgaaatgacaataatatgaaccactgtgaccaagatgacagatacacagggatagaatctgccaagacagagttaaggccaggatatggtttcagaaataaaggtagggagaaattataccttagaattaatgacatagcaatatttcaatataaaaactatctgaggtgaggttgtgacttattttcttaatactatgtggcatttgcttgtattctgataagtatatgtttaacaattagaagggttttcatatgtgaatgcttacttgggtcatttaaacaccttgtcccttatacaagtgtatcagttcttctcctgctctgtcctggccagtatgtctgtgtgcataatagctacggcaggagggtgacaagtacaagattctgtgactctacaacatgactgagtgtggagatgtgtctgtttgggggaggggagcagggtgagatcagtgcaaggaagaagctgagtggacagcaacaatgaggctggggagtttttcacagtttagtcttgggcccatcttttttttttaaactaattgtggcaggacccagaggacatttaataacctgtacgacatgatctggaaagcaaactacagaccttgagtaactcagaaggcagcattttctattattcagaaatccatttattttattattctgtcttcttccagtgaatacagtggtctatgcgatgtgtgcagaagggagagagaaaccagagaagatggtagggtgtgctagctgagtaatgaggtgtgggtggtagacgaatatgttaatatttttattaattgaggtttctgactaaatttgttctggccccttaatattttgctgtaaaccacggtttcacccacgcacacatccataacctctgcccaggcccatctctgaggaaggaggcagagaggatactggatgccattttgttagtaagaagacaattggcttagattgtatgggaactagtctcagaaataagctggaggcatatggaaaacatctgtcccctgcctgccacttccacacacaacttacagttgtactctaaattcccatttcatgttcaaagctaaaaccattatcggcaaggcacacctccaaaattacaaaaaaaaaaaaaaaaaaaaaaaaaaaacgcatacctccaaggcacacaagaaaaacacgttttgctattatcaagaaattaccacaaaataaaatgtatgaaaattccttatgaaagtaaaccagatgagttgcaaatcacatagcttttcaaaaagtactgaatgaaagataattaaagtttagattttgggaaaagaagccaggacgttctaaaaggccatacagaaacacctgatttagagagtaatattccatgtggtttttaaaggcctccactccatagtaagtaaaacattctccccccacttcagtcacaaggtttcaagttaggaaagggccactgggacctaaggcccagtgcttagggacttacataaagaggcacgtcattgcagctcaactccatgactcctgcatctgtaatggaaacaacacaagcattatggtgggaagcctatcaccagccctcagagtcctctgtggcccacattcagtgtcaacattatggaggaaggagtacaataattaagaaaactacagagatattaaatacacacacacacacacacacacacacacacacacacaaggactagggtcatagatcaatggtggcatgcttgcctagcctacaccaaggcctggagtccattcccaagaccccttcaaaaatgaaatggaaaagagacattctcttacataaaattattctccccaagaaaacacaatggcatcccttcaaaaactaaacacatgatcagtaatttgacatctgagtatatacacaaaagaactgaaaatgggctaagcagtgccaaagtgaggacagtagcctgtccatgggcaatcaaaatgcagtagacatatgcaatggaacaatattcttcaaagtgctacaatgtgaatgagacagaaagattaaaaaaataaataagtcaatcacgaaagaaaaaaatactgttgccattccacttacatgagatacctaaataggtaaattcatagagacagaaagcagaatataaattaccaagatccggaattactgctcaatagagacacaacttttatttgagaagataaaaacacagtcctaaagatgggtgatggtgatactacacagtacaaatgtgcttaatgcagctgaatcacatactcaaaatgatccaaatgatagatcttatcttattataacaaaggcatagaaaggtatatacagtatgtacctaaggcgaaataagtagctggaaataaatattcaaatcatgtgtgtaataacatatacatgatgtacatacatgcctacatacatgtatagactcatctttattctttcagattagtttccacaaataaggaaatcccatcactaatgactatcccagaatttggaatatttctaaaagccacagaggggcaacataaacattaggaaagcttgaaccccctggagtgggctccggaatgacaatctatttctagcaaaagtaacttcatgagctggacctgcggcttccagagtctgagaaagacatctcatgaaagataacactaacaagaatataacagaatagtcttagcatggattgcttagtatgaaccgaactgttcgtcggttcctgtcagaaaatgaaaacaatgtgcaactcaagagccctgacaaatggagggctgccaaactccttgttatcttttgtcttttctttttctttgttttgttttgttttgttttgttttgttttctgagaccaggtttctctgtgtagccctggctgtcattgccctgtagaccaggctggcctcgaactcagagatttatttacctctgcctcccaagtgctgtaattaaaggttggtgccaccacagtcagccaaactccaaattatcaagacagcactttaaaagtttagttcaactgccgggtattggtggcacatgcctttaatcccagcacttgggaggcagaggcaggcggatctctgtgacttcgaggccagcctggtctccagagcgagtgccaggacagccagggctacacagagggaccctgactcaaaacaaaacaaaacaaaacaaaacacaagtaacagtatacagactgagcaggttgtatttgtgtgcttgggagtgtatatgtatgctacataagttaatggaaaaaaggccattattttgaatgagagcaagaggagtatatgggacagttttggagggaggaaggggaagggggaaatggtgtaattataatatcaaaaactgaaagaaatatttttttaagaaatagacattttctgaaactctgcttatattttctagacatttttttaaaaaggatcaaactcaaggctttggtattctagacaagcactctgacacagaactatattccagtccttggtctttaaaacagagtcttagttataagcccaggctggccttgaactcatcttcttgactcagtctcctaagtgctttgattacaggtgtacatcacagcatctggctagaatttgtttgttcattaaatacaacaaaaaaagaagtggtccaaggggaatgggaagagatgagagtggatgtaattatgaccaatattcaaattgcattatacacatatataaaaatgtcaaagaatactgcatgtgcatgcacacacagggcgtgtgtgtgtgtgtgtgtgtgtgtgtgtgtgtgtgtgtgtgtgtgtgtgcgcgtgcgcgtgcgtgcgcgcggcgctctcaaccattatgccaagcagagtgttaatccgctatcctgttcaacatgactcagtagctggtgttggttcaaacttcgagtatctgaactgaaatagtttattttaggcatatttaaacacagcacaatttggtgagaaattttttcctggtgataattaactcaagtctatgtgcccaataaagcttaagacatgactacatcgagaatctttgcaaagtacatggggcatcttccataaagatgggttctatagatggactaagaaaaccaagctcatgataagggtcttggtgaggaaggtcaccaggccacatccactctcagccttctaggcggaaaacatctctttccctttgaagaaacaaccctgcatatttaacattcctggtccccctagtacttatctgtgtgtgcaagaccctctgtgcctctcacagaatacctttttaaatatgttttaaaatccaaaagaatgaaaaaaaaaaacatttggggtgagaatgtgaagatatattctgaaagcaaattattttattaacaaaaataaattaagataaaataaaccatgaataagacagtggctccgacaaagatgtttgttttggtcctgggggcctgggaaggtatgcgcatgtatgtgcaggttcacaatggtcagagggagacttccagtgtcagcttatccctttaagacagtctctttactgaactggaagcttgtctttcggctggccagagagctcccagggtctgctggtaccaacttccaatgttggggttacaggcacaggtggccatacctagctctttatgggagcactcgggattctaactcaggtcctaatgcatgcacagcaactcttaacaaatgagccatcctcacaaccaaatgagtcatcttcactgccccgatgaagctttaaaagtgtcacacctgagatccattcactttgtcatttgtgaacaaaatgctataacaaagaacttgaagccaaaagcacacagaggtttacaaacctgtagcctgtaagaatggatcatttcacagaagtatttcaacgcactcagatcattacaaattctacaggaagtagtcataaaggcctttaccacattggggaaaacaggttatatggtggcagtgtactttttaaaggtgtcaaacaaacatgcactgcctatttttttccttataaatacagaagtactccaaacttcctgggattcctaaggtgggaagtctctagttatattagagatttggggggggcactcaaatgacctgttctttccagaaagaagtagtgctataataagtggaaaaagaaaatgcattccaaaggttgtagacagttgtcacagtgaggatgttttggaaagaattagttgggcttcctcctcctctagggtctagcctagtaaatggatggaactagaaatgatcctactgatcgaggtggcccagacccagaaagacaaatgtcacgtgttctctctcatcagaagctcctagctccaaatcttcaggtgtgggaacatatcctagagttacagaaagtaggaaattaaaaagggacagttgccatgttagggatgtgggggaccaatagagagaagaatagcagggtacaagagatctgattaggggaatgagggaaaagggaaaattctaaccagggaatagcaagggagataaatatagaaggaggatgatgggggggaaacaatagtaagaatgtctgaaaaagtcatagggaatcatactattagctatttacctaaaaaaaatatatatatatatatatattttatattatatatatatatatatatgtatatatgtataaatatatacatatatatgaaacaagctaggcgattctccctccctgagccaaagatccctggaggacctacctctgcctcccatgccaccatagctgtccaatactatgattctttatagtaatagtgtcgaatattgtttagaacatgcaaaagacttaggacaccacctgattaatctttttctgtggagtgggaaccccacaccacacatcaaacatgagaagcccttttttgagttgttgaccagggctgtctaagacactcccaaaacatactgcctattgctgttgccctttggttacccccaagaggtggaaggtaagtgactattgctgaagacaccatgtacttcccgaacagggctcagaggtcctcagtgggaactgacttgaacgcttacactctgaggactaacttcatgatagcagaaggaaggacacaaccaacaactggtctacctagccatagcaccatgaactacaacaactaacatggtacaataactctgagggttagtgtgaagtcatggatcttggaggagaaactaaaaagcaccactttactaaaccagcactatctctaattcattctaaatatttgtccttatacccacagacaagtgtagtcctcccccttttgtcaatgaaatgtccctttgcaatagacagactatcacagagagccacaaccaatcaaaacacagagttgtggagcccagtcccagaggatacatctacaaagcaactcctacagttcaggaaacattgcaaaagagcggtggaaagattaaaacagccagagggtcagggagtttgctgagtttgctgagtctccaagaatgtcagaagttacactcatatagttccaccaacatgactgcctaaacatgagctaaacaaggacaacagcaatagacatccatggtggacaggggcaagatcaaaaggcctcaaccatacacaaagaactacgggcaactaaagaacgctgagaatgggagagatagtcttcttcagggaagagcacaccaattggttatctaataccaaatggttaggcctgaaaacatatgtacagataacaatatacagaactagtaggttgtatgtagggataatatgtatgtaacaacaattaatgaaaaagacactatgaatttgaaaaagagcaagaggtatatgagagggcttggagggaggaaaggagagggagaaatggtgtggttatattataacttgtatgttatattacaatttgtatgcttgtgtgcatacccacggtttggagcatttgatacaaagtttgcaattacagtagccctcacatctgtactctgtaaattttggggaaatcttttttttaaagcttccaagaggagcatttcctatctttcccgtttcatttgtttgatttatacaacacctcctggtgagtttgcagaaggacagacagctgtcagggatggtgagcatttctttactgacacagagaaggggggcttggactggaatctaagtccctcagtcctgatcagggcagtgagcagagaaaggctttgcccaactctgtaccatagggaactattttctcgtcctcaaaaactccaaacctatttcaaagtagatagcaatgagaaacaaagactccaagcacccagctgctgtttcacattgatgatttttagggaataaacaaggaaggttaacacagaaactttactaccatgtttaatccttatagctttctccatttttacataggctataccaagtgcaccattgtgttagtgtagtgtataagtaaacacatacatacattaattatgatacatgataacccttttttttcttaatagagtacatactagcattttgaaaatctgcttctaaaaaaccaggcccttccccattggtcaggacttcctatcagtcttctttcacttagtccaggtgggaatggctgatgggggtaagggtcaactctaaggtgcaattctccagtgcatgtgacctgcacccagggtgaggtggtgagtgtgatctgcacccagggttaggtgcaccttcacctggcaccatgaaggacttgttttctccatatatcactcatcagtccacataaggctaagggagacagagctgtctcggctttggtctcaacagaaacatccaagcccagataccacctgttactggttttgtaccttctgtttagtaacttattaaataatcttatttcttccagctcaacctcttggtatttagtatagcaacttaaaaaccactttgattaatattaattacattttccagaataacccctttgactccttacgcaaaataatcttaaactaaaatatgtgacattagtttttgaaaaactgggtttccttgaaggttttaatattctgtaaatgtattagcttaaatgtctggctcttgttactgtggaccttaaactgttctgtttttagctttgtgtgtatgtggtgtgtgattgtaagaacatttgtgtgtgtgaataagttcacacatacacaccatgatgcacatacagaggtcagaggacaacttcagatgctggcccccatcttctgccttgattaggcagggtctcttgtgtgtgtgtgtgtgtgtgtgtgtgtgtgtgtgtgtgtgtgtgtgtgtgttttcactgacaggtgggtttctggggactttcttgtatcgtcccatctccctaaaggatctctaggattatgtgggatctgggtattcaaactcatgttcttatgcatgggcagcaagtgcttcacacactgaaccatctccctaatcctgaaactgatttaaaggcatttctattctgataaaagtaatagagtccccaatttcatcccaagtccttctaaaattcctactgacatttcctaaatgagttacagagaaagtatttagggaaaaaaaaaaaaaaagatccacccaattcaactgtcaaacttcaaactggatattatttttaaagtttattcccctttgggttttcctcacatgaactcctctttgtccatgggaaggggttctgagtcctgctgtcccctcgctaaactatgctgggtctccttctacactggtggttctcacccctcctaatgctgcgatcctttaatacatttcctcatgctgtggtgagcatagcatgaggaaccatccaaccataaaattactactgttatgaattgtaatgtaaatatctgtgttttccattggtctcaagtgacccttgtgaaagaatcgctggaccctcaaaggggtcacaacccacaggttgagaacaactcttctacaccaaatttagtaatcaagtaagtttgtattttgccaggccaattgtagctgcacttggcctttagcatctccctgtataaatgtcatgttccagcttctgctgtgtttccaaggcctgactccctcctataacttctaaatggttatgttcaaatccttaaaataataataacaataagaccacattttctaaaaacattttgggaaaataaatgccaaaatatttccaaaaatctcacagaaaccaaaggatggtttggactatagtccataacatttttcttatgtttgtctccaaaaaggtaaacaaatgttactaatgagatactaaaataggcttatattacatatccaaatatcaaaaaaatctttgattgctggttaactctaaagaaaaatattagaccattttgagcaagctaaatttgtaaagttaggaagaaaagcaaatggagcactcaatttgcaagaaaaaaattcatgccctcacttaaagaaattccgggtttctaactcttgtacctcacctccaaatgaaatattcatggatgtaaagccatgacttcattgtttgagtgtggggatttcttggggttgttcatttgtttgtccatttggagacagggtttcaccatttagcctgcctggagttcactatatagaccagactgactcaaactcaacaaagatccacccacctctacctccaagctgctaggaaggcctacaacaccacacccctcagagctaggtctttaattttgcctttgaatatgataataatcaatgtcttacattccttttataaacccatagcaatgtgtcactataaatattagtaactaaactcagaaagctaacgatatagcacaccccatgccaaatattttacaaacatggcagcctgaagaagagtgtggaaaacaaaatcttgaacatgaaaacattctacacctaactcacaaaattatgtgcccagtaagtgccctccccactcctccactgcctcttccctccactcagctattacacttctgcagagcaacaggcttttggtagtttctgtgttttttgtctcactgtgatttgcaaatggtgtaataaaatataaattagtttaaaactcaaaaggctttaaggcattaattttttataaagttgagaaaaacatcattgtttaagttttatatatgaagcaatttatcaataagactgaggtagcaagaaacacagaaaaaatcctaagacagccgctccaaacatattaactttaatgcaaaagaaatgaaaagtgtgtctaatcaaatggcagcataacaatgctttgaaaattaaaattgtgatgtgcaatcacttttggcagaaatatgcctgcaccatcctcaatcctacacagacagacagacagacagacagacagacagacagacagacagacacacacacacacacacacacacacacacacacgagttcattctttgatcactgtctgggttagcacaaagttaaaagtgaaaaatggcagcctgcataagatcccacagcaaatggcagagctggtacccaaatcaactgtgacgctaatggagaagggaaggacagtacactctggctgtgaggccaagtctccgagacagcctttgatgccagcacaatggaaatgcgtaaggaaaaagcatttaggcatgaagctactattgaatagacaatgctgactatataaacctgtctcagactagaatgatctatctgtcatgcaagtctcaaaagctgtaagaggaatattaaactatttcataatcaccgaggacgtctctgaagattagaaaggaaacaacaacacagtaactcttcaataggatctcattaatgcaaactaatgggggtgggggggcagggaggaataaggagagccagtctgaaatagtgcagcctaaattagaggttgtttataaagtacaaagaggagcatgagttggccgctaacagaatgttccgccaagcctgtcacactcatttgtatttctcaagatatatttgcacagagacacagtgattaagccctttaaaagcttttcccaaatctactgaacttttgctgattctgtgagtctccgtggactgtttacagtcaacacaaagctccataaccatccaagcatcctgaggaagatgacgactttcaacacctcaattccctccttagcaagaaatctccaaagttcctcttgaatgctcagagtcaactcatcgtggactgtgtgtaaagcatgctgtaggctgtcttgggagggacactaaaacatagaagacattatgcctgtcacggtgctcacagcctggtccacatgataggcaggaagatatcagaaatggcactggtgactggcagaaggtgatggtgggaagccagcataaattgacaagggagtccttggacagaagggggttcaatatgaagacaggcttgatgcagacacagagttcaagaggatgaagccagagagaacaacagtgacctcctacatctatacagaatccatccctacaagagacatcctgtaactacacagaaggcatccctaagtcactcactgtgtcttgacagacagaatggagctataggggctgaggagatggatcattcagtaaagtgcttaccacacaagcatgagtacctgagtatggatccccagcaataaaaccaggagcagcagtgtgtgcctgcaacccctgtgctgagtggtaggaatggaggtaggaggatccctctggctttctggctagataatctagcagaatcaaagagagaccctgtctcaaaaaagtcagtagagtgatagggaaagattcccatgtcatcaatcactggcctcccatatgcttgcacacatgcacacacacacacacacacacacacacacacacacacacacacacacacacactacttacatagaaatgaaagggatgaaagggggaagggttctttgacagggtctgatggggaatgtccttctgtgtatgtttatcctattggttgttgaataaagtactgttggccactgaagaagcaaattaggtgggattaggagtcaaggaggattctgggagatgtactaaaaggaagtcttgtgaaacaggcaggaagtgacatagcaggcagacatatatataagcaagagcaggaggaagaagggtcctgccaataatactccctgttatatgttacctttttgcccaataacatgtatcccagtttcctctgctttcccctcatggcagacaggatgccttattaaggtcatgggaaggcctgaccctgacagctccaaatttgacacaggactcatcttgaacatctcatttccattttgcttatgctcaattccatcttagaaaatcagagcaaagacacaccgggtgagggtctaggccctgctccaaatgatatgacagactttgtagattcccccatggaaggccgaaccccccctggggagcaaaaagaggttgggatagggggtgcagtgtcaggggggtgacaagggaggaggggaggaagagggaactgggattgacatgcaaaagaagcttgtttctaacttaaaattggtctaattacaattataaaaataataataataataaaaagaaaatcaaagcaagagaacaagcaaaccacacaaagcccggctgctaaaactaagctggcaggtagggccaccccaagttcattcattttcggatgtcatgagaaaggttgttttatttattgtagctattctgtctataaaatgcaaagcagcaacctggacaaagagaagacaaatgacacatgcctgagagagggaacatgaagtttaagttcaacacaaagccttactaggcaacttgctttggctcactctcattttacaagctaaagaacctcccctttttaatttggtaaaagggaaggtgactttttctgggacctaatgtggaatttctagaaattaatatgttaactaagccatgagcttgtaatgcatggtctatgaatgcactttatagagacatgaactccatgaaattaatgtatgattttatttatatgtatttttctggcaagagtttaaagcttacattgggttctcagtggaccattaaaacttgaaaaaaagacaaaaatatatcctaccaaaattaatttcttgctttgtgaaagctcatgttaggagactgaatggatgtagtatgggctaggggaaaatatttgccaaacatagacccgacaaggaactttcaaacaacctcactggcaaatacacagaggacagagactaacgtttcactgcagagagtacacagatggcaataaacacatggcaagacactcagcatcattagccactagggacatgccaattcaaaccacagtgagatcagcacctgtcactcaacatgaaagacaaacaaaaagggtgcatgccctggagagaatggggaaacaagaccacactgctggtgggataggaaagggtacaggtactatggaaaacatcaggggattcctaaaatctaagcacagatgtgccatcagcaggtgcactaacggagaaataagaacccccgttacacaaggccccagatactttcatggcagccctatttatagcagcctcaacactagatgatcccagaagtccttcagcagcatgacagttcagcttcagaacagagcgacatatgcacagcagaaacatgtggtcggcctcctcattcttgggttctgcattcctgcaccctaccaaacacacactgaatatgcacttgggcttattatggttgcatataaactaaacttgtacagatttttttcctcatcattcttcccccaacaataaagcattacttgcctaatgatgataggaattataagtaatctagaggcgagttaaatatatgggaggagtcacatgggttatatgctaacacaatgccatctctataccacttgaacatcctccaatttaggaatccatgtgaagtcctaggccaatacctacccatgcaaaggaacagccacaccatttaccaacacaaaggaggaaagtggtggcatggaaaaaacttcaggaagtgagactagagaaatggcttaacaatcgagagcatttgctctaacagagagcctggattcaatttccagcattttgtcaggcagctcacagttgcctctaactccagctccaggaggacctgatgcctcttgcctccataattgcctgcacttgtgtgtgtcacaatcaataataatgtaaataagactttaaaagtttcaggaaggtatagtaagcaataaaagccaacccccaaaactggtaggtaatacaatcctataaacaacatttgtgaaagaaaaatgtcaatcagatgggaacagtttgggagttaaaaaacagcagttgagtaaagatgtaggaagctaattatgattatagaaggggaaaacacagttgaggtttcataaccattcaatgtcttacatgatagtagacatacaaatttacacaggtgacaaatgacacagcacagacattgaaaactcatgctgactcatggaagaaaagtggaaagcttgaataaggttgataagatgtatcaatgccctccatgcttgaggtttttttttcttaatttcactatttaatatttattttatcttgtgagtgtatatatcctgcatgtatatatgtgcaccatatgtgtacctagtgcctgaagaggccagaagagagtgtaagaatcctggaactggagttatagacgttgtgggccaccatgtggatgctgggaagcaaacctgggtcctctggaagagcaaccggtgctcttaaccacagagtcatctccccagtccctagagaggtgtgtgtgtgtgtgtgtgtgtgtgtgtgagagagagagagagagagagagagagagagaaagagagagagagagggagagagagagagagacagacagagacagagacagagacagagacagagacagagatgggggggggctgagtgcagcaattcctgtggaggccaggaaagagcatcagattcccctgaagctggaggtacaggtggttgtgagccatctaacacgggtgctgggaactgaacaatgtggataactacttaggtagaaggaagaattgccaagaagactgtgaaagggagataccacaggcaaaagcaatagacagaaccactagaaagcataaaggaagatattcattgagctacaaagatctccagagcccgcaagaaatatgtgtataaggcaaatcgaagaaagactttgtcaaaaccccaaaataatgtcacataacaagcataaatatcaagcttgtagggggtggggttaaggtgacagatgtgataggaattgtttttaaaagaaaactattgtgggtggtgccagatggatttgaagcaaagaaaggccaaagacaggaaaaccaggaaagggatactgctgtccctcagggagagatgctgctgcccctcagggagagatactgctatccttcagggagacactgctgtccctcagggagagacactgctgtccttcagtgagacactgctgtccttcagtgagacactgctgtccttcagggagacactgctgtccttcagggagacactactgtccttcagggagacactgctgtccctcaaagatgccactgtccctcagagaggcactgctgtccctcagggagacactgctgtccttcagtgaatgacctgaatgctgaatgaaagcaatgccatagaaataactctagagaccttcaagaaagaaaatggacagccttgttaccaagttaattggagagcctgggggtttctaaggtgactcttggggtcccagaatcagaaaccgggtgtgtggtatgctactgaccaggattcggatgcagagaggaggagaggcagacatcaagacagataccaattactaaccatgggttcccagaacccacaggaaaacggtttcataccgtaacaatgaattttagaatttaagattaaaacaacaacaaagagtttcccttttccattgactactataagtgtcaatgacgttagttgaaagaaaatttcaactaacaaataggcttttttttttcaacctgaagggctgggtatgtagtgcagtggtgaagtggtgagtgtgcacaggccctagaactgatctgtagcactgaaaattaatcctgaactcctgaacattagaaatggtgtaggtaaacatcagaccccacccttgagataattagagacaaactcagtcacacatatagttaacaacaatctcaagctaattctgacattccagaaaatacacagtactgtgtaataatccccttggtgtattctctagagaagtagtacttagtttcctgttttcaaaaatgatctactagataaaactcatattctactttcccttgctattactaactcgttttaagtcaaatagaaaagcaacattattcttacgtgacacttcaaaattattgtttaaaaatgttcaacctgcatggattccattaggatgaatggctttattgtatgtcacgggagcactttgttggtagtccacaccaagggaaaccaaataaaaaggctttgtctttccggccgtcttgctgtggacaagtgggtgagccttaacattgaatactctccaaagcatacactgcttgtagtgaggcaggtgaactcgggctttttccttcttcatggcatcaactcatactgtgcccttgcacccaaatgcccctcctcagctcgtgtttactacgatttgaatgtcactatgctgtctcagacaacactgagttcctaagttgagtccccagtgtggggacgaagagggaggggatggaaggggcaggggagaaggaacaggaacaggaacaaagtgttatgctctacagagcctaaggggacagacatcaagtcaaggtagattttcatatgccatgaactgaaccaacactgtgttccagaacacacaacctcaaaaattaatagggtgtgaagatccatgcacagcagaccaatagtcagaatttgatcggtgcttctcatcacaatattagccctgttgattttcatctcagtcctcttcccagaaaccatctatatgtatacacattgtattggagtcaccagaggaaggagactcagctgaggagactcctccatgggatctagctatgaggcattttctcaattagtgatcaatgaggaagggcctggccctagactggaggtcctgggttctataagaagacaggttgatgaactgaactggaatccagatgcagagaaggacgaatgaagagcaaaggggtccagaccaggctggtgaaacccacagacacagctgacctgaacatcagggaactcttactccccagactgatagctgggataccagcatgggactgatccagaccccaggaacatgggttacagtgaggaaaccttggaaatctacgggatctcctgtagtagatcagtacttatccctagcataggtgtggactttgggatcccattccacatagagggatactccctgagccaagacacactggggtggacctaggacccatcccaaaggatatgatagactctggtgacaccctatggaaggcctcaccatccagggggagcagaaaggatatgtgataggtagggttttagttgggggttgggggttggtagaggaggacgggagagagaagggaactgggaatgtcatgtaaaacaatcttgtttctaattcaaataaaaaaaatcagaaaaaaaaaaagctcaccctgagaaaaattttaggctacccagtgtagttgctggtgggttcatgctatacttaattcttcaagtacttacttcataacattaaataaaatgccatttactgattaaaaaaaaaagaagaagacaggttgagcaagccatgaggagcaaccagtaagcagcacccctccatggcctctgcatcaactcctgcctctgggatcctgccctgtttgagttcctgtcctgatttccttcagtaatgaacagcaatgctggagtgtaagccaaataaaccctcaccccaacttgccttttggtcatggtatttcatcacagcaatagaaatcctaaccaagacacacataaacacaaaccttttcctatctggtctcttattatctttattttatgtatatgagtgtttgcctgtgtgtatgtatgtgagccatgtgtgtgcctggtgccagcaaaaccagaagaggatccaggtcagatcaccatggaaccagagttacagacagttgtcagcctccatgtgggtgcgaggaactgaatccaggccctctgtaaaagcagtaagttctcataaccactgagcaatctcgccacccatttagttcccactttttgctaaatgattgttaactgagtgtcatgattaaaattaatatgataatagatcctgttgggtaaaaatcttagtttatctctatcagtataccacgactcaaaaatgggaacccagaaaaaaagcaacatgcacagtttgagatgcagcttattcaagaagcaatcccacaatcagacctcttgactaaattacagaaaacatgtaatttcctgaggatttacacacatgtgtatgtggggcagttagggtgacctaactcacatgccacaaacttgtctactaatgtgttctataaatttagactacacgctgtgggagaaatgtcattatagatgaaagctcatttaacactctgtaaaacatagatgtgaccggcacttcacagagtgtctagtgaaattccggccaagtgagcaatttattgatcgacaagcatagcaccagttccagacaccagccattatctacttctctgttgtgaggccaggccacactctgcccaaataattcacctttaccttttgaactatattaagagaataaacattacattacaattttaaaacagtaattccatctgtatgatgctaccacactttggacagaaaaatcattttctgctgtgaaagaaactccttcatcaactgctcagagattaggcctttgggtggcttgcttcctttttatctctgcaccccaaaccccaccccaccattctatcaactatcggttttcccatgggggttccatttgttcctagttgctggaaggtacttcctctttctctggtacatccaacccctccttccctcctcagcatgctcagctacaaaccctaaggtgagggaaacaaggtgattccaggaagcccaagttctatgggaagagatccataatagctaaggctatggcttcaagaacattaaaaagaggcgaggcttgctagcagagaacccagaggagatatcgattaagatgccagaaagtaactgaaaacacacaccaaaatgaaactggagcttacccagcaggtgaagcttgtaggatgacctgagaggaacttgtccattgaatttttacagctctcctttctgctatattactgctttaataacctcagggccttactggtcagaaccctagctaaactatttcaggaattactttaaatgagtaatagaactcttcaaattataaggaggttctccaaaagccataaatactgtcataaatttatgactaagaatcttcccctgaggccttgtgaggggtttcaagagcccagaagatccacttctaacaggctctgaggaaggagacaaaatcttgactcatgtgtgacggggaagaaaagctgaaagtcctacatggggcaagacacacagagtgacacctttagtcaaataataattaacaataatactagaaaaaatatggcaacaagctaaagggaaagaaagaaaccattttccaagcctaagctctaagtctgaaaggggggagggtcccctcagatactctaactgaaaaattaacatggaaaatagttccacactacaagcacgtgtaggctaactcagaattccaggattcccacagttatcatctcattggacacagactctcaacagcataaaacactcagcaaaactctccatctccaaagacaacataaaaagtaaaaatctgtcctttccaaaggtcaaataataggttaaccaatcagcctataagtcaatagatttaaataaagatgttttgaaaaccagtgaaaacattttaaaaaatgaaacagggtatcatccagaaggatgatgtcaagatgactaagacgcaaaaaggacttcataaaaaaagacacagtttaaatgttcattgaattagttaaatagaatagtgaaaagtcaactagtacacactggattttgaatcttaagaaatgagtccccacaccaagagagagagaaaaaaacagagaaagtgaaaaagataaagatccattaggaaaaaacaaaatatagaataagcccaacatactttatataggagttccagactgaaagagtgggcaatgcaccagaagaaatcacaagtgttcttttataatttctttgaattgacaaaagagaatttctcagattctgcaactatattagcaccacaaatccatcaaagcaaacaaatcttaggcaatttgcagagtgatgtgtgatttcaccttaataatattttggatggtgaccacgaaaatacagaagtggatgtggtgtcactcccctctggtccctgaacttgggaggcagaaattggacaactgggagtttggaccagcctgggctacattttgagatcaaaacagtaaggaaagaaatagagaaatgtcaaaaccatcaatgctgctcctccacaatgtggacttgtggggaaggacacaagcatttacatgccttttaaaaacacctctactctctgatttgtgctgaccacatactttatctgtaaatttttatttgtattttttgtttaagatttatgtattaattatgcatacagcattctgcctgcatatatgtctgaaggccagaagagggcaccagatctcattacagatggttatgagccaccatgtggttgctgggaattgaactcaggacctttagaagaacagcaagtgctcttaacctctgagccatctctccagaccctgtaaattattttatttatttatttatttatttatttatttattatgtatacagtgttctgcctatatgtatacccacaggccaaagagggcaccagatctaattacaaatggttgtgagccaccatatggttgctgggaattgaactcagggcctctgcaagagcaggcagtgctcttatcctctgagccatctctccaaccccctgtaaattcttaaaagcaagttaattataaacaatttctaatttcaaatttaaattgcaaagtgaagaataatgtaactatatatttaatatgtagtttatatttaagttgtatttaataagtcttaaaattttaattcttaagtccttcaatcttttaattttttaaaaaaactaaaccaccacaaaaaggaaagtaaattaccaaactctactgcactttgcgaccccttatctgaaaaaaaagcatctgtttttcaaagctgtgtcaaagacaccatctgcagtactcagtctttactataggcagagtcctcctccctggctctcacacactgtcctctgaaattactgccaccatttattgccttttgctcaaagcctgtcagcactatactcatccccctctgccccctggtgtttcttcttctgtgggagaaaacagttcctttgattatttccccctcacatcacttgatcagatccaaactggtcctcttttcccaaggtccctactattatcaaatgtactaacaggctagggtagagtgcttgcctaaaggtactgggcctctgaggctcctaatcctagcccactgctgaatgccttctctcaccttccccacacccattcattcaccaagtggtggtcaatgctgttcccatctccccttgttactacttcatccttattgtcaatctggcagccatacaccttcaccaccaccacctccaagtctatgctaagagcctggtaagccatcatcaagggcatccatcttgggaactagtgccaggtttagcagtcagaagtcaaagtcactgtttccaccctttattcctctaatgggaaaatggcccctggtcaccatttgccacgtaaaccctcccttagccaagactagctttccatgtgtccccatccatgctctacagagttcaatcagctccaacctatcacccccatgagttccttcttgcctagtctaatattgtgtggtatgtgtcattagaggttgaatgttggttaagcatccactcattctatgacttcatgtttcctgacctgtttcttagttcatgttgcaaggatcaaatggaacccaggaggaaagacacctggagaagtactgacactctgaatgtacttggcaaatcacagggaccattctttctctctttgtcttcccaataatggtatcttcatttatcctgaaatttagccaacagctgacacagctctgtttgctaattgttcatctcatcttccaattacaatcttcctctaggatccttctctattctctgtacctagcaaaactgacttaagtgagtaagttcgtttgttagactctttgagaaaggccagaggacaatggcaattgtttagaaaacatcaagagttttctataatatttgggtatctgctgggtatcaagatattttatgttaaatatcatatcattgagcaagagaagcaaaactctcagcatttccgaggtttgcaatttattgataggcaataagtagtgtctaaaaagcaaatgttatagcactttagaaggttgtaggaaagaataaaaggcagaagagattggcaagggtgtgctgcagattatttgtttaactatgtaaagatgtattgctgttttaccttgtctgcctaaggcacatacgtgattgatctaataaaaagttgaaaggccaatagggaaggaagaggtataggtgggacttccaggcagagagattaaatagaaagaggaattcaggcttgagagaagaaagaaaaagagacaccagggtccagacagacagacatggaggaagcaggaaagtaggacatacaaaatgaaaggcaaaaaggcccaaggcaaaacatagatgaatagaaacaggttaaattaagttaaaagagcttgtgggacaagccaaagctgaggctgagcattcataattaataataagtctccgtgtctttatttgggaccttgttggtgatccaaagaaaatcccaactataagggtgttagtaggtgcacctttaaatacagctgttgaggaatgccaacagggaaaagttgagcaaatgtgagggctgagctctagaagcctggctatgccataagcatgtgtagtgagctgcaagggggccaaatacctgaagcagcgggaacagaaagagagcaatgaaagatgaggacagagaagagtgcaaggtaaacccataaggcctcagagatcaccctgaagccccgggcttccatcagaagctgagaagccgtctatggttctgagttgaggaatgacatgaggtaacatagatatactgacaggcgtgcatactaactattgtgcagcaggcaggctgagagcagtcaaaggcaagagcaggggacttgctggaggctactgctgtgactcactacaaagaggataatagctgagacagagacgtgtcaagaaataaaatggtgagaagtagtcggatttggaatatatgctgcagacagctggtaaaatgtcctgacaaataggaaaagaatttgagagaggagtgacatctatccctccaagcttgaagtctaaggaaagcataaagcacccaccagcagacatggggatggagtgggtggtacggagctgggtgagggaaccaggagtttggtaacagatgttatcagtctgatgcatacatgaagagctgtcccagaggcatgagacacacactctgcatcatacccacaaattcctcttgtggctgagtctttatgattagagctctagcagggaggtgaacaagcctaacagagaaacagaattctggctggccctagagctcaaggtcaagcaggggaagaggaaagaagtccacagccaaaggcagcgggaacatccaaagcagggcttttagaaacaaaaacaccgccacattctgactacagcagacaagatacgtggaaagaacacaaggaagggaaaccacctggccatttcacaagaaacctcctctcacagctcagttctctagttagaatttggctcatggggctattttccttggaaatcatggttattttacaaagaaaaatgaatttgaattttctagcagtcgagaatgagtagctaactataaacgaagcagctcaagtcaaccctagctcctggtgacctctgccttccaactttgtttctcagtgtgcaagtactgtcttgggagtgctgctttcccctacctacacacaggctttctggaaatcaatgggtacctgcatattaagcaccatgagctactcaaataaagggacagtgaaactgaatctgtaagattctgaagtctagacacatcagttctattttcttataaaccccactgaaattggggtgctaacacagacctgtaatcccagcattcttgagacaggatgatgatgagtcacaggctagcctggacttgatagaaaggccctgtcttcaaatttttagaaatgtcaggggcatgattctgtggcgctatgcttgtctggtgtccacaggccctgggctcgatccccagcactgaaaaagacagataactgaagcaaaagttattttgtactagcctgtggatacaaaatgagatggcatgggacactcttttgaagtacaattatgaaatgacctcttgagataaaaaatgcaatattaatcaagtcaaaaatcattaaaagtcactaaaaataagctaaaagctgttgctctacaggaagctcctccctggggttaaatatgctgacctgtgagccatagttaggccaaacccctgtcgtacaagctggaagcacgacaaaaccctgagagaaaacacagacctttgtccaagagctgtagaatcaggcgcattgtaagggccatccatgaaaagagccctgttgaaggcgttttctcccttattttccacgtgctgtccaactccattcaagtgacgacaattagcattgaagtgaataggccactgtatagatactgttcgtgattcacagagatgggaatggacgtcagtattcaagcaaccttgcattttaattaattcctgcatcagagcatgccaaggaccagaagaacacacagctctgtcaaagcaagggtgcgctggcattactgtgcatggagggggggggcctttttcacacctacactttttctctcaggaaacaaaagcacatgatagtcagaaaagtatcaggcacatagaaagcagaagccagccagcagctggacagaatgctgaggttggcctgagtctgggtagatgagaatgagttcatttcaacagcattttacgttgtggtccaactatggacacctgagacaagagtccacacatccccaaggtcagggagtccagatctctcatctactaattctggatttccatttctgtgtttactgcccactgacactaatctcctactggtctccccatgtctatcccagttcactctagtccttgtagcccatgactaaaattcacacctgaaaattctgcctatgctaccgtctagccccattcccttctaaatccttcagtggctcccaacagcccagaatgcaaaggtgtccttgtctctccgtgaatgagacagccccttcagggcctcagtcacgatgctctttttcttcagagcagacatttgtgggatgttggttacccggcctctttcctttttctttgttagcacctggatcttccctctgggaaatcctccactgagtataacttcgaaaggaagtagaattccataacccttacagaagccatgggatttttctcagccctatccctgccccagcagagccaagagctggtacacggctagcatgcttaagcaaggtcctctcttaaacagttaattaaattatcaaagtccatttatatcattcacaggcaaaaacaatggctaagtcactctgcaacttacaacttcaataagcaagccagccattccacttatggggaccaattccatataccccagacaccacatatacactgctacccctgtgacatcttcctggaaaatagaggcaagacaggagggcctgaagagatgagcctgagtcagaaatgccagtcctagctcagaggctgggtatgagtagtggggcagcccagaagagactggacaggatgttgagtccagacagacagatataagtcagccatactaaagggaagggcagaggtggaccaggagggcagaaatatcccatcatatacactgagggagagagcatgactgtgggtaggatttaagctccctcccatgtagctgtgtacaaaatataagatgaagagataaggagctagagatgaaagcaaggtccactcagggggcaccttgcacagtgaagacacctgaagttacagagaagccctgaagaaatttaacatctgagtcctcacatcatgaggcatctcaatctgattcccataattaactttgtgaaattcctatatccagtcttaactcattcttaatagttacataccttcataaaataagacaaaattcatgtttcagtaaacccggtccaaaagagcttaatctgtagacatggcacccccaaaatctattccagagcagggagtagaaaaggctggagtttatctaagtgaagagttctaaaaacaacaagctcaaggaaatcataaccctgaaatgaaggctcccaggtcttatctccaataaggtatgtatctgtggacaagttaaactcattaagccttagtttccttctctataaaagtgaaggatggcaatagctacaaacctgggtgcacagtgaatcaaaagtatggcaagcctctggggtgtgctgcctggatgttgacactactctatccccagctcctctaggctggaagacatgcccttacaccctgaggcatcacctcaggcctgatgacttgagaactcagtttcccacctgtaaagtggggccacaggaggtgcagtgtggcctgatctaagctttaatggattctagatgcatacaaacattattaccaagtgcttatgtacttatgaatggccttctcagagacagacttccaacaccacctttgaatttccagtccaaccactttcctcctgtccttcataaacccacaaagactctttattgcttactatgcctctaaaatccaattgccttccacttttttattgtggccccactctgcccagcaatgtgatgctgtttcctcctgtacccaaatgtacagcacctgctgcccatctcattctcatagtccattcctcccttttctctccctccctccttccctctctccactgtctctccctgtcctgtctctgtctgtctctgtctctctctccacaagcagatccacttcctctcctgcagggagaccctccctccaatggccccaggcataatcattctctctgaatggaggactccagagttctcagccaaacttccaggtgagatatctgacttggctggctaacatctctacttccttccttctactgttatctcaagtaggtaataagctgccaaagggagaagattgtatcaggcatttatagccctgcccccctgtcagttgagaatagttcagacaacacagaagagcactggggacctcacacctctctgcagcctcaaaactttatcctcaactcacctccaaaaccttcaacaagcacttaatgccaatgggagcctcgatgatgagagcaagtcctcaggtctatagtccagagagacaaaacagctgctgcagcaagagtaagaggagctccaggtggttatggcattaaatgtggactcagatttcaatctccaatcacagttagagaatgaagttgcctttcccctggtaggaactgaaccacaaactcagatacagatgcacgtcacagattataaaacaagaaaaaatgttaggaaaaggttagaagtccctcagtgagcatagtaatagataaagttatgaaatcactgaaaaccatcagttttgaaaagatgtttaagggcataaagccccactggctacaagtttgctatgcataggttctatatgttcatatcttataaagcaacaacaataagggtagcttgggagagaacttttaacatcccccatcatctctgccagccccctcccccaaaatgcaatctaaacaacagcacaatctgcagagccttatggtgacaccagagctccttcccgtacaactgctttccctcattcatgctcttcgagacctggaatcgcctctaaaagtgtggtaaccatttactctgcacagtaatctacagcatgtcagtattccccttttaatgacagaactgtgagtcctaagctaccaaatgaaccggggtccggctcagaatttaatccagcctatcacttcagagctcacgactaggctatgccaccaagagcaggtttcatgccccaacaaactgttaaatcagactattaaaagctctgtgtatgtcaacagatcagtgctgaatgaacccttatgaaatttgacccaattcattttcacttgcctacacatctcagtttggccttcaaagctacttggtcctttctaaacagttgaatttctgccattggttctgcagatcactaatttccatcaccacgcctttccacagacaagttttccatggggtacatgcataggaatatcacaccaccagaacacagctctcctaatgcttctgcaagtgaactgtctgcagttctaaagcaatcctgcacgctttgggagagttgactacaagacccatttagctcacaacctcagtcagggtctctcccacccacaatggttagccacattcctcaggagaacgaggggttccatgttgggattcaagaaagtgcctctccagcagcctgctgggagctttacacacatacttctctccatgcccacagccatgggaccaggatactcaaatcaaagtgagtaatgggacccttgtagaatagggaaccattcatcaatatctctctctctctctctctctctctctctctctctctctctctctctctcccctgccaccactgtgtcagccagctcttctgtgacccccttgagtgacaaaggaacagctctgttccaatttctccatttccctgctattactcttcaaacaagcacagactcccttctggtattttccaggttctttatctgttagcaacaagtagaaacatttaatagaaataacaagcaagggtttcttacagaaccttaaaaggtcaaactgaaatagtgtaactaaataaaattaaacttggaaccagagaaggttggatgaagcacacggctgacttcattttactcattaggaacatgtctttgggcaaataattttctattcctgagcttttgagatgtctggttttcatgtgtctgagttcaataaaataagagggttgaactacattttggctatagcttcctggtcctaaagggcatcacagtgaacactctcctaacactttaaatatatgtgagtctgagatttctggggttcttgctaccctgcagagtatagtggaacctatctgtcatcccagagggattgtgagtttgaggccacatggggttatagggagagactgactctgaacatcaaaagaggaggggagggagagagaaaaagggaggttgtctttattcccatccacatgtcccactcagtgaccctctccatttctttcccaactctgccacacacacacacacacacacacacacacacacacacacacacttacacaaaatacccttgagcaggaccacataatggctaaaagctggagatttagccccacacatagatgctaatccaatttaacaactgattatcttgtgactaagcaagcaatttaacataagcctgtttcaacacatgtaaagtggggaatcaacatcatacctattgcataaggtagttgtagggacaggtgaatagcatgcaccaagcccttagcaagaggctggcacgtgtgtgctcacaacgcccttatcatgggaatgatacaggtgatgaatgctcttgttatgttactctcctgaagtcgctacatgggctgagacacatcccaagagtcacttgtgggaaggaagagagaagcttctgtttgcagaagggactggaagggggtgagagggagaagtaaaccattgctggaagattgagtaggtggtgcagtcctggcccctcactccctcctgcctattctgtagccatcacatcacaggaaagctattatttcagctacctgaccgtgagagacacgggacagggatgagagagtggaacagtctgtggcttctgaaactgaacgtgtttggggaacagtcagccttccatctaatatgatgagaagctgtgtgcaggttgcattgcattccaggagtcatggataactttggctcatcttctggcaatactgtgtttcagatataaaatattatccactctatgacataatagatatataatatttccaggaaagcatttccccaaaaacactgaaccagaactctcaacacaagggtcccatgcaaacagtcacatcctgctctttcacagttcacaggcagctgccgggaaagcaagattcaaaatcccagggaaacatggatgttctaggcacaggtcattatacttttcaaaacatcatctgtagaagcaggggcctttccattagatcagaatatgaatgtcacctaaatgtgtggaaatgtcacctgaatgtgtgtaaacagcaagtttaacaaggagagcagaggaccaccaccccccacacacacacctagaaacatcatgactcatgacaagcatggaggaggggcctgtagcatgtgtctagaataatgaaaacaggtgagctattttgttatttgtttgaaatctccattcaattacttcattcattcaactaattataaaaaaatttaaaacatggaaaataaaagagagaggtgtctcagtccttttggtcttaagatgttcaacccaatgagaataacagcccacgtcagataactgtatgtacaaagtgtcacatgaaacgccaagcattgaattaaattaggacaggtgggagcagagactggtcagaggagagacaacagtggctccaggcttaccctgttattaattcccacctttattttagtggcagaatacttccattttagctgggttcatggtcatcccactaaagtctcactgtccagtatggtgtccacagtcacaaagactactgagcttagaatacggccagtcttacatgctaacataatactaccttagctacattgtcccaaatatgctcattgatttactttcaccttttatttttataatgtcattattggaaaatttcagactgtagggggtttgtttactctttttttgaaatgaggtctcactgtgtgtcacagctggtctcaaactcatgaattcaagtcatcttgcctcagcctgctgaagagctgagatgacatatgccccctcacctgaaaatctgagattacatacatgtctctcattatatttgtttagacggcacggagctaaagactacatcacaccgccttccgtgatgttgtctgtgaggatgatgcagtcacggctagtcagacgtgactaggaatagtgtgcccactgtctaatgcaggcaacatcctcctaactcctttccctgttcgtgctggatggatgcaaatgtctagcgctgacccaactgcaaccatcaagtaagccacatcggtgacccagggataatggaataatctgttgcctggataatcccaggagtgatccacccggttccccagaattctgtaagattagatagctaggcaagagaagattttatctaagtctctctagagaaacctaaactgtaatccagttaatgcaagggggcatgccaggaaagttccaaaaggggccaatcattttaaggacatcttaaagaacaggagctagccagagtaagagcccagagtgttgccacaaggggcaacaagaagagggatcacttgaggcagaggagacaacagagaaggaagaaagttcaaaaccatcagggactatggtgagccctcaaatggaggctacagaggtgagtcacgtgctggagagccttggagggtggaaagctaatgagtgactgcccgaggagggggcaatcagttctgccttacatggagctatccagtgtccgtgcagagtcccatctgtggctacagccgtatgaacagaaggtggcagaggtggtaatgtatacctgtaacccagtattcaggaggtggaggctgaaggattagaaatttaaggtcatccttggctacatggaaagtatgaggctagcctgagcttgagactgcctttaaaaaaaattattaaaaccttcaaaaagcaaaatcatcctggggtaggaagagggaggccaaggaggtggctcagcaggtaaaagtacttgccacacaagcatgatgactagagttccattccccctcctcattacaggaatgagacacgaatctgtaatcccaacattcctatgacaaaatgagaggcaaacacaggcaaatcagccagaagcttgctaggccatctagcctaaagtacatgatccagtagagaaacaagaaggacttctcctctctctctctctctctctctctctctctctctctctctctctctctccacacacacacacacacacttaccctctgggtaagtaaataattacagggagcaataagaacagagaacagactagactggtggggggcgggggtcccagcttagagaaagatgtccacagccaagaccagatccagagctattcaagtagacacagagaaaggactggtttcatttcggcagagtctaggctgttgttcgtgccacatcatatcataagcagctttcccctacagacacacacaccaatgcttaaaaacagcaccagaatgggatcaaggatgcagacttcaagagggcattcagggagaaacccaatgataacaggtgtcaacatctaaaccagtggctgtatgtacctgagggaaggagaagagggggtaaagacaggaaaagcataaatccacatcccaggagcccaaaattctcctgaccctctcctgtttctcagggggaaaaaaggtagagaaacaaaaacaaatatgacattggtagtaaagggctccgcactgtcaggagacttcaagtttctgctcagagtagctctttactaaccccagcattattttttagtaataacagcatcccaaattgcttaatgcatctcacctctcctatgtctgtactatgttttcagaggaattaccacacatgtcaaaatacaattccattaaagtttggttcaaaattaaaatcagtcaagatgaggttgaagttcacagaagttttgttttttgttgttgtttttgtttgtttgttttgccaggcaaaactactagaatatgctaactttacagaaattgcagattcatgtcatctgttttctttctgatcagctaactaaccccttctctttctttttacttatttattattactgtgtttatgatgcacgtgtgtgtgtgtggtcttgcacgtgccacagatgtgtgtgtgtgtgtgtgtgtgtgtgtgtgtgtgtgtgtgtgtaggcaaagggacagctctgtgggtcaggtctctcctccttgctttactcaggctccagggacccaactcaggttaccaggcttgtggggtgagagctgctgagtcatgtcaaccagcccacatacttcactgacttctcgtgaaatagcatgagaagaaatctctcctttctcaatctaaaacaactatgaataattaggaaccttcatgatctaattattatacaagtgtcttttaaaaacatgacccagtgagttccagtctccatcatttttttaattgacaataaaaagtttgactcactttgataaaaattctaccccctaggaaacctgggattaagatgttaataaggctctcagagtgttaactgtaaatggatagactattttcttacacagaggaactctacacagtggctaaaatgactttcttgtatagagaagcaagctaattgacagagggaaagcaacagaaacaactgtggttttcttttctttccttttcttctctattgtttagacaggttctcactttgtagctcaggctggcctggaactctatgtgtaccgggctggtgtccacggagattcacctgcacctgcctctccagtgctgggattcaaggcatgcaccaccatgctcagcccactgtgcctttttcattaaactgttcctgggcaaaaaaaaaaaaaaaaaaaaaaaaaaaaaaaaaaaaaaaaaaaaaaagacctactccattagggcttaaggcaaattgccaggcctcacctggctagagattctaattcatggccttggtgaccatggtttatatcttcaaagcctccttgggtggctcagagaccagctggtttgggatccacttctctaaagccagaaaatgccatctttgatcacagggcctagtacacacagtatcacagatagctgaactctgtgctgttgattcaagcatacagcacgggtgaaaagagcccagtttgcacaagtgtctgagttaggtgtgggagcccagcatctagtgggtgagaaacaaggcgacacataccagtgatatgacaccatacaataagtgtcactgtggaagctgattcacacacttactccagcaaaagggacagatggcgggtgactggctcaggctccaggtgtcctggagagcaggagctgcggggaagagggagtagaggcgagaaggaaggcaaaaaggagaatggagtgcaaatgcagacagcctgggtgtgctctgagtggctctgagatctatttggcagggtgcaggccagacagaagcacacaccgcaaagatccatgaaggcctggcaagctcaaggagcccatgacacattctaggtagacagctggcatgccctgccatgtattttagagtcatcaccctgaaagcagcagagatgggcttgcaggaacctggaaatgggggctgtaattaggaagccattatagcagcccagagaaatggtgatatctgaactatggggaacacagctaaagtcacaggaagagactggcaaaaatgataataaaaacaacttttaggtttttatgttaaatttcaatgtgaacagtagtattcaaaagtcagaagaattaaatgctcgttaggaagcaaggttaggaaacatatcacacctcttactgctttagtgctttgcattttaaatacaaaaatcccccaatggccacacagagtggcacatttaaactaattcagctttgtctatggtcactactgtcattacctatttcacagcaaatgtttgaacacacagttaaactgtgctcccgaaatcacacaagtgcatccatggtgagcctatgcaatgccaaacctccctgaattcactctgaaaacaaacacatataacgtgcagggctcaagcacgtaactgggagtgaccacgcttaaatcccacgtcaatcacaatgtgtattaagggacccactttaaaatgggctaattagaagcttccatagatatcaacatgaaatagtgactgtctgcaatggctgaggccttaaagcagaaagaatattgctttttaatagcagtaattctagaagccagagacggcattggatcctgactaaatagactagtattggcttttaaaatgtttctaaattctccacagaaaatacatatcctgttgtctgcaccctggaggtcagggaagggagcaatgcagttgtccttgggaatgacatgggaaactgaaggacccaaggggacagaatcgaggtcaaaaatgagcatgtacacagtggaacaaaggtgaacagggtaaacccatgagaggagctgaatgagaagtcttgctcaagttctaagcatttaccaggcaaacaggctcctgggatgtgtaaaagagctgggaatacaggtgcagagtggtcagaatgtgggatctacaggattacgcctaatcagaagctcttccctctaaaaattcatcttgaacttggaaaagtcataaatgaccaactggatgacgatttgcctagggggtgaaaaactttttttgaaacttgttcatttttttctaggaagaattaataaaactacgtaagtcagatcattaaacatagacggtaatttctgtccaggagggcagcattacaaagatgaagagacatctttccctttgaagacaaaccagaaaatggagcctcagtggaaatttccaggaccatttgactagagcaggtcctccgggtctcttgaacatgaggacaagttgaatcctgaccaagccttccacagaaccatgggcggaaagggaagaaaggtgcaagaaccccacagatgggtcaggagtcaagctgctgacctggagcatgtttcctaatctctccactccataggttccctcgtgtgaaacacgttgcacagtaaggtcatcgtgggaattaaagctaacataccgatatgagttaagggtgacatacaataaaagctctgccattttcttgcacgtcactgaatgcagaagtgctagattaaggttcagagttgaacaaggagaaactgccaacaaatgatcagtactatggttaagaatatcaaactccagaactcctgtccctaggatgggaccttcagccattgctgaatgcatgattaaaccacatgagctgtgtttctgcatttccattttcacagatgttcgctacccatccaacataaggtcatcatgtttcaccagaagatacagaggaaggaagggcttttatttggttgggtttttacttctttgggttttttggaggggttgttttattttgttttttttatatgttacagaagtagagccttgctagggaggaaacagaaatttatgactctagaaaaatcaaagtataattgactctaaaaatttctaacataaatagaaaaaaaaagtaaatgtaccatttctgcaactgatgtgattctaaattcaactgagatgagcaaaaacatggttttctttcccttaccttttttataggttactaactcaatagaaggcatcttttaataatcaagtttgaattaaaagagaccaatgctgagagcagtaaaccaatttgtgtgtgtgtgtgtgtgtgtgtgtgtgtgtgtgcatgaatgtttgcttgtgtgcatgcttgtatatgtctgtgtccatgtttgtgtttgcatatatttgtgtatgtgcatgtttgtgcatacatgtgtttgtagtgtgcatgtttgtgctcaaatgtgtttgcatgtgtgtgtgcatgcatgcttgtgttgcatgtgtgtacacatatgtatatggttgcttctaggtgtgagtgcaggcatacacatactgtgatgtactcttggaggtgagaggattaccttgggtgtcagccctctccttcccccttgtttgagacagtctcttgttcacatacactaggctagctggccttcaagcttccagaattctcctacctctgttcctcatctcatcacaggagcactgggattacagacgaacactaccaagtatggctttacatgggttcttggaatctgaactcagttcctcatatgtatgtggcaagcactttacccaataagccatcttcccagaccccaaaatctttaatgaaaaaggaggtaagcacaggccaactgcttaactgtatccatcccaccccctccctaaacaggacagacatgctcataccaaatgtctttgacagtaagttattttccctaacaaaatacttccgtaactaagtggccttatactgtatctaagtagtggaagaaaatacgaacaccatctttgtgaccttcaatacagaaccagacagccgtagaatacagtcactcattagctctgatccttacacaacaggcctctttcaaactctctctccctaatttgaattggctctgcagttttctcgcacgtcactgaatgcagaagtgttatattaacaaagcaactcaggatctggcatggaaccaacagcctctgttctctcacacccatatgtacagcgatagtaaatctatgccttaaaaaactgactgcagagtaagttatagcttttctttgtatatgcatatgtcatttaaactttgcacagtttccatctatatcctggcttgatcagaaaattatcatttttagctaaggagctggtggtttcctctttcataggtcaggggacaaagaatacaaaacacttatctaaaattacactaagccggccatggtggtagcacaggcctgtaatcccagaacctgagaggtagaggcaaaaggatcaagagtttaagtccagcctcagctacataataagttctcaactgtgctgtgctatatgagaccctatccctgcccctcccacaaaagaaaaaactaaagttacactcagtttgcacccctaacttcccatttaattttgagagaccaactgcattttaaacaaatgcaacacattaataggtatttgtcatactgacttctagaggagaaatctgtaactggctggctgacacagtaaatcctgagctgctcgctttatagagagaatagtttcatcttttcttcttgaactttttaaatggctgctaatatgagtgatgcaaaggagagctttgcttaaacagaatgtatgcttgtgtgatagtgcacacctacaacgctcagtaagctagagcaggaagattccaaattctaggccagtcaaggctgcagaacaagagctgtctgagacagacagaataattatcactaaacagccatttgtttggcaatagaaatatccaaaccttagtgtgaacatagaacacatttttcttttttgagacagccctggctatcctgaaactcactttgtagacctggctggcatcgaactcacagagattcacctgcctctacctcctgagtgctgggattaaaggagtgggcccccacacccggccacgttacacacctttagtaccagcactcaggagagatacctagacagatatctatgagtctgaggccagcctattactccaatggcattctgatgcaatacaataaatatactaaacagggctagattatagactttgcacatcatacatacaaattgcttgtattcattgctcctagaatcacagaaggtaacagataaggaaactgagactaaggtgtcacagctagggaggtagtcttgtggctaggtatctgcctggttcctgcatgtgaaatagagaagaatcccaggaagagaattctggaacaaagggatcatgcccaggcaagtgcagccccttctctcatctctgaatcatgccttaataatactaatacctccagcttgccattttcaagaatgctagctgtttccatgtgtgcttctcagcttaagcaagttctagtttagacagtgacatcagttacaaaagcaatatgctccagaaaggatccttcactataacattgacattaagcaaactgttgacttggctcttttttacatatattttgttatatctagataggaaaatgttcaaatgtgaaaaatatattatagaaagctagttattaaggacagcctaaagtttttactgatatgctatggtggtttgaatggcccccaaaggggatggcacgattaggaggtatggtcttgttggaggaagtgtgtcactgtggggacaggctttgggtctcttgtgctcaatcttccctcagtgtgacagtcagttgatttcctgctgcctgaaagatgtaacactctcagctccagcaccaggtctgcctgcatgccgccatgctgcctgccatgatgatgatggactgaacctctgaaactgtaagtgagccaccccaattacatgttttctttataagagttgccgtggtcatggtgtctcttcacagcaattaaaaccctaactaacacatatgcattgcaaagctacctctaattgcaaagatgtcacctcctcctcttaaaaatgtagtctttagtgttagatgggctacctaaaactcccattcctctaaatgttaagcaacagagagctcacaatccgcagcatgtaaccagacatcacaaaaagagaatgctcctgagagttgaaaaatcctgtttttttttttttcattagaagttacctgttgtatgcttgccctcacaatgtataactcactgcagatgtggcccagtggcaaagcacttgacgcacaaacccataagtacaatccttagacacacacacacacacacacacacacacacacacacaaaatactgttaaagaagagcaattaagtctatattgagtaaagaagtaaagggcatttggggactgtggcaatatgtcttactactcaagtgtaaggacctgagtgagatcacccagaaatatatacatacatacatacatacatacatacatacatacatacatgcatacatatatacatacatacataaagccaagtacagcgacatgtgcccacagtcccagctctggagaggcatagacaagaggatccctgtatcttgttggccaggcagactagccaaatcagtgagcagagattcaaaacagaataaagtagagagtaactgaagaaaacacccaacatcaaactctggtctccacagtcatgcacacatgcatgcatgcatgcatacacccctatacacaggcacacacatgtacacacaaaaaaagaaagaacaaagaaatgcaggaaatataaaccaaaaattatatactggcagggaagaaaagtatttggtaaatcaccacctttaaatcaaacacttataaagtcaatagaatttacaaactatctttattatcatgaaatttacttaattttacagatatatatgtactttttttcctggtcagcaaacatatgatattcccaccaactgcacacgttgctgaattaatgacaaaacgcatctttgcatgtgtccatgtaatttcttaacttagagaaagatggtttcttgattctttccaagtctgtgtctaaagcatgtgaaaagagggagctggtgcctcctccctgatgactaagctatcaaagaatctgaaggtgctatgcaggctgccaggagagaaaaataactaacagtcttacatatgtaaagcttacaaaccatagcaatgaccattacagcaagacatttccaagggtgcaatagtggcacttatatcttaggggtaaccaacaattacctaatttaacttccacttatcagtagggaactcacacttgggactgtaaacctagccaacaacctgtggttgataaggccatggaacctagaaaaggaccctttatggccactttcctaaaccagtgtagttctaaatatctaaaaacataaatacacaggtatgcatagctctcactgttcattacacaagcttctttttgaatcaacagagaccattacaggaatccacaacttgttaaaatacagagaacaactgaccatgagatgctcagctccaactgatacatctacaacacaatccctatcctgaggttcaagcagcatagcagaagaagaggtggaaagactgtaagatcagaatgtctgcagagagatggtgacttctatatatgacagggagctgaacccatgaaatctgaaaaatatggtgatctaaataagacctgcatggtgaaaacaccagctgatattccaatgtggatggaggaattctagcaaggctccacccctagatggagagctacaggcaattaatggctgcacattctgagagagagagagagagagagagagagagagagagagagagatagtcttctccagggtctagttccctaataggctatccagtcccaagtggtcagcctaaacataataggttgtatttgttttgttgttgttgttgttgttgttttggttttggttttggtttttcgaaacagggtttctctgtgtagctatggagtctatcctggcactcgctctggaagccaggctggcctcaaactcacaaagatctgcctgcctctgcctcccaagtgctgggattaaaggcgtgagccaccaatgcctggcaataggttgtatttgtatacatgtgtatgtacacatgtgtgtgtgcatgtgtgactgtgtatgtgtgtgttgcatgcagcaatataaattaaagaagagatcatgagtttgagagtgagtgagggggtgacttggagaaattgggggcggtagaaatgacatgaatatagtattgatatatgaaactctcaaaaaaatcaacaaaataaatgtaaaagtagaaaagggtagcttctgatttgtttcaattcaaagtatgtcaggccctttgtaaaagtaattattgcttagttacatatggatacacacacacaataatagaaaaacaaaagccctccctaatctctccacagatgactgtgggaacaatgtatcatgtaaatgcaaccttagctataatctgtctaaagccatgtttgcaaatccctttggaaaatcctacgtgctgggtccataaagatccactctccagacaaaggcatcctgactggacatgttcaaaatagctctcaaagacaaacaaacaaaagtcactgtgcaccagccacaccaaagaagggagaagaggaaccgtgaaaggctatcagactggggaaaccgaccacatatttggaattctacagaaaaagttagcaacaagaagaaaacaggcacctggcaggaaaaaatgcaaaggaaattattgagacgtgatacacttcctgtcaaaacaacacacgaggtggtgattcattccaatagcatcttctagaatttgtgcaactttaaatgtgccataaattcaaccatgtttactgtgttgtagaaggattttgtgtttttgctttaaatactaatctaatcatgtcacactgtgcccaaaaatgcatggaaagcagaatgtactccctgtatccatagccatgccccctactgccaccaagacaagatagcacagtgccaatgaccttcccttgtttacttctgacttgagctgtggcctttggtgctgttcaatctaatggagtgcttagctctagactggagagctgccccttggcaacaaaaatataataatcagctcactgttgacacaccaagagagtcaccaggatctttatcagatgcttccagaacttgtcaaaatgatagcattcttaagtatttgaggtcagaaaaatacaaaactagatgtttccatatattctcacccatccccccaccctacccgctcctgctgaaccatctcatcagccttcccaataaattcaagatgtaaaaccattataaataagcagattgtcaaaataagcttaaattagttgggtctctgttttgactttcatttgtgtgtttatgtgtgtgatgctagtgcatggacccaggcagggtcttgcgtgttcaaagcgaccactctaccactgggctacaacaatccctaaattgctatacataattctgtttgataatacccaaacttttcaccccctcaaatagttactataaccatttatttccaaccccagctttgaaagttttaaagtatgggcaatgaggaaccatgtgtgaatgtcttaaggaaaaacaagacaaacaatggtttgtgttggaatactaaaatctgagattcctccagcttcatttatgagctaaaatgaagtgctgtgattttcactacatttcttcactactgtcattctttatgtttattttaaagttttattttatttatatgtatgtatgtgtgctggtgcctgcagaggctggaaatgggtgtgagatcccttggatagagttaaaggtaggtagttgtgagggacctgatatgggtgctgggaacagaactccagttctctgcaaaagcagaaacagctcataaccattgagacatctgtccagccctacactctttcttattttcctattgtcaccaaagcgacagccacatgtttacaatacagactacatttacaacaccatgattgagaggaaaaaagcaagcaagcaatatgtggtaacttatactatcaggcatggcttccagaaaaaaaaaaaaaaactaaaggtgacttcactcaggctgctgaaagcagccagtacataccatctctgcatcactgtctaccaaatggcagacaatggctaattcagcagcactaagaaccttttattgctggtctcccagaacccagcatatgtctccctctatgtaataatcagccaaattcagtgaaggctcaaaagtcagataagccccaccatacactacacacacacacacacacacacacacacacacacacacacacacacaaaaaaaaaaaaaaaaacacacttccctggagaagaaaatctttagaaagaactctagattatttgaaagttttgaagtcctactccaagcccagcgattcaaatcccaaacagaacaatgccaggttcctgccccagtgtctaaagcagccatgatgcagaatatcttgagcttgagatatcctagaaggtaaacagatgtcatgcttttaaacacggctccttatgaatataatttggcatagatcatattaatcatcaggaaccacatgataaactgggttttagaaattcattatgccaggcatggtggcacacacctttaatctcagcactcgggagacagaggcaagaagatctctatgagttcaaggccagcctggtctatatagtgagcagccaagaatacacagtaagaacctgaataaaaagaaaggtcacatatttttagaggaaaattgggatggaggtggtaaagagaaagaagaaagaaggaagagagtgaactgttatgaatgttcttactttagttgaaaactgctatttatcaaaaatgccatacatttcagggcatgttttcaaccaaggggagcagggtacattaagtcccactgctaaaatgaaattaatatctatctctggtcatcttcgaattcaattaaaataattcctagattattactggctcattctgcctggctgttcaggaagggctctgacgacaacaacaacgtcatgagctgctgtgacagggtcacccccaagtccttctcccctgtgaagatacaacactagactaccatcttcaaacccaccttcctgaacatctgcatgtagccagccaagggtcttggcacctcgggaatcagggcccacgctagatggtaacccatgaggcttaaggcaccatcctccctccacaaaacttcaaaaatggagccaggcctggtggcatggacttatgatcccagctgctctagagcctgagacaagaagattgcaagttcaaggcctgctcggctgcaaagtgagcttgaggtcagtctaggcagctaagtgagtccctgactcaagataaaaacaaagtaaaaggggggactagaaatgtagccagggtggaatgcgcctagcacaatgccttaaattcaactgccattgtctatccttcaactactggtggtagttgggagggggcagtaggacctgagagatagaatgcacagtgggatgggacggccccaaacccttggatttcaatgacatcatagggggcccatcgagaattcaatccaaatttcagttctagtccagcctgtggtatgctcagcctagaaaccttcctcctgtagataattcagttgccagcagtcaaacccaactcacaataacaggactgttttaaaattcatttagtccagatagcttaccgacttcctatttctcctgcttcatatacacttctgtagaatgatagctaataaaaataaagactcctgccaggaatgcagaaggaaaaagaaaacctggatcttcaggtcaaagagattgttcagtgcgtaaaagcactcactgacaagcctgatgacctgagttcaaaacccaggatccacatagtggaaggacagactaactcctgcaagctgtcgtcttggcctccacatgtacaacatggtgctcacctgtacacacacacacacacacacacacacacacacacacacacacacacacacatacattcatgcatacatataaacaaacacaaatatacatacatatcccaccctattattctcttactgttgttagttttttgagacagggtttctctgtgtagccttggctgtcttgaaactagctctgtagaccagactaccctcaaactcacaaaaatccacctgcctcagcctcctgagtgctgggattaaaggggtgcatcaccaccacctagctccaaaatagcattctttttaagttttaaaactctcctctaggggctgaagagagatctcttgtacaggacctggttctattctcagcacctgcactccagctcacagcagcctaactccagctccagcaagtccaatgccctcttctggcctcctcaggcaccaagcacacacatggtgcacatacatacatgcaggcaaaacactcatacacatctaataattaacaagaacaaaaccctgctctaataaagcaatctccaaagagcacttagtattctaccaagtcaaggcctccttaagctggtcatgggaagctgagttttctctagctcagcccatgtctgttaatctagaaatttctgaagatcaggcatattcagggtagtatagccatgataatccagtgtttcggaatgttcaatgctattgtaaagcaaccaccggtccagcatcgtcaaaccattataagattttaacacatttagataagaaggctaaaaaggaaaggatgtgaaggctttctttgtctcataatgaacaaattcttgtccaaattctaatctttgaaataaacatcaaaaaatgccttcacactgttgcctttccaatgagcaaacttggaatttactggtggtcccacaagctttgaatttattggtatgacaagaaacacactgctgagagaaatacttctactttcagtgggtaggagcacttgctataagcaagaagacctgagttcaaatcttccatatccatatagagcaccaataaaccccagtgctgtggaggatggaaacagggggatcactggggcttgctacttgccaccccagactcagcttcagtgaaaggctctgtctagcagagaatggacagggcacctagcatcttcctctggcctctgcatgtgtgcagggattgatacatatccacacacaaaaaaaaaaaactaaataaataaaaatctaattttggggctaaagctcagtaatagaacacttactctgtgtgcagaaggccctgggttcgatccacagcaaacacacacacatacacacacacatacacacacacacacacacacacacacacacccacacacacacacacacacacacacacacacacacacagaggaaacctgttcagcccctggggactgtgataactgatacaaaagaaacttccaaacctccatccctgagaactttggaccagctctgaaaattttggcagctctgaaaagcagcatttgagagctaagttgagttgcacatgagagtgactttctgaagtgcaaggcaccagtctgcactctgccaccggcataaatctgaaccttagttttcaccaactcacaccatctgaattcacctccaccaaactttactcacaattaaatcacacctaaaacattctcccagggtgcaagcagaaaggtcaggagttcaaggtcatctttagcttcatctactgagatcaaggacaatttgggctactggagatcttgtctcaaaaggaactaataaggaatcacaattcataaaaaatgaccacagaccatccattgcaaaggagattgatgctaaggaagcctgagagggtattacactcaatgagctcactagagccaggcctcctgaccccaagcttactgttcacaccaataaagagttgggacagtgacaatggccttcaattgctgcactcaggaggcagaggcagatggatctctgtgagttcaaggccagtctggtctacacagaggactccaggacagccagagataaataaagagaccttgtttaaaacaaacaaataaaaacaaaaacaaaggatgactttatttttcctgctcctaacccactttcaagaacaaaaatgagggagccatgttcccaagagttgggtcgagcagatggaagcccaaataacgctgaatttttccaacaaaatttcatcttaacttagtttataagcgagggtgtcaaaggcagagagcttcatgcagatgacagagtatagaagaatgccaaagatgggagaagaattctgtccacttggagttcagaaagaggtggtcagaaaggagagaaaggggtgggactataactcactgccatgcagaacacttgcctagcatatgtgagaccctaggagttggaaaacttgtaactataatctatgggaaccgtggagaatagcagcagagtcagaccaagaggtaagcattgtcattaccatctccaaaggcagaacctatagatcctaggcagaaggcattccaagttgctcctcaataaggttctggagatcatgtaggaggatgctatgcaagagcttcaaagagaaaggcttgaggccaatggggctctcaacagtaagttacttgagaatgggcccatattcctagatggaggcaaaatagatacagtgtacatccttgtgacaagaaggaagattaacagtgaggtgctgacacaaacggtggtcattagatccctctacctgatgctgcttactatctatctgaagaagtctgtggagacacccatttcactccacctagaccttagcctaaatagcaggggtttgtatcctacagaatgcagtggagggtgtaataaatgtatcaatgcgttaaccaatttgcaatgggtggaacagccataggcaaggaaataaatctaagagagataaatattgctcagaggactaaaaaaggaaactgcaagtctatgaacgaggtgtggctcagccgccacacacattaaaaggaggtttgtaattacaagatggttgtaaacttcaaaaagcaactgcaccactcacaagcaccgcagctgtaatgccattgtttccagagttgtgtgtgaaagaagcccttatcacaggcagatccaggtggaggctaaccgtttgggtgacttgaacggcctggccctatgactgaactgcagctgattgtccccatgagctggggagctgagggagcagtggtcctgctgcgctccatcagatgcaagaactgcattctgagaaggaggtagcagattggaatagtcagcacagcaagagaattcaaaaccacatatgttatcaattttttaaaatgtcattacaagagcaattgttcagactggcctgcatgctgcagaattgtggtaaagctggctgaaagaaacaccaatggagcatcattcggcttcccacagactagactatctttactgcctagcagtcctttatcactgtatcgggacagctgcttagccatttgggagtatgctatgtgggtgatgtgtgcactgccagagaccagacagaagtttccaggtgtctgtcaatccacagattcagattccatcaagaatttcacttgtttctcctggcagaaagaaactacttctttagagaagttcacagagtggccctgatacatcaggaaggccagccacctacttgcttcctgggaacccttgaccttgcatcccttcatcccggtggtttccaatgcaatccatacacaatacacaggagcacaccactgctaatctttatagagatgctgggtactagaaggactttggataattattagcaaaataattaatcaaataacacatgtgcactgcactttaagtccctgcaaagtagcctaaatcgggatccctgccaccactggtcgtatagacaggctgaaacactgacactcacacagaaacacacagtaggcccagtgcctggtgttgtgggaattcatttccacaacagcctggtggcaagtgatcaatgagaagggccagcaatagagagacaagggctcaggtacaaaggcggctctcaggctactaagttaatcaaaggcttccaaaaagactgtgcttgagctgggcatcaaggattataataggtggtatctcagtagaagaggcctcccatgaataaagtcaagctagaaattgaatcaactctcagtatcaaagggctgctggttccctaaccttcacagatcctaaaatcccaagatgttcaaggctcctatataccagtgtagtatttgaatggaatctgtgcacttcttgcattctagataatttctaataaccaatgcaatgataatgctatgtgcatacttgtgatccaggtttatacaggtgttaacagccaggaaataatctgtacattttagacacaggattaactttcaacccacagctcactgaacccaaggaagcccaactgtgaatacagctggccaactgtatacagtagtcattaggcatggctgatggatgcaaagtgttcacaaaaagagacaacaagaggatgactgacatgtcagcagcatggaaggaacaccaagggaaatgataggagctgctccttctgtagacactgtaggataaaggatgccagaaacagctagaaaagtggcttatgttggagtgacctctttttcaaatgatgtcagatctacctggaatggtcccagtgaatagtatacccgggtttggaatcctgcaggaggggctcagaataaatcgcccactgtttcaccaatcagagggaaccctggacattctgagaccctagtatttggataaacagcaaaccatgcagttggtggagcaagaaaagggggaacagtagacaaagaaccaggtggcaatgcacaggcaataagtcagagggcttacggcgaaggcagacaactgtaaccaaggctcattttcctggaccacaaagcccagcaaaaatgtcttagaagtcctcaatgagacttcttttgccccagaatttatctgcagcatgaaatcaaagaaataatcagcttgattaccattccttttcagtgccacactatttcacaaggagaccaggtagccagctgacccacgcacgtgggatccagacttccttgtcagcaatctcttgggactaagtccagaaagataacctaagtctttcggtgtgctgactgtaaaggctatgtccactgctgcagccaaagtgctcacctggagaccacacatgcccagtcttgtggattgcagccagaaaagttgaatagactgagactctggttacctgtaaacctcaacactgcacagaatgtcccaactgagagggccatgaatctcatcctttctggatgaagaaagaccagaaatgactcgtacttgcccaaggtcacaacacagatgagcagttatgaagaggtctatgtctgccttagactcccagccaagggcagtttgccctggatcatactgacatttcaccacctttgctgctggaaagaaagcccactaaagccaggcatgcaggcagctgctggggaacaaagccaggcctcacatgctgagctttgtgttgtatctaccactgagctccactctaaccagtaccactctttataaatgcttcatttctatctgttgtcaacataattaccaccactgtgtcactccataacttatctcatcttcaaccaatgatgccagttactgttatcctggtttcactttttttttttttaaccgggtactggtatttaacccagggtcttatgcatgctgggcaaggtattctattgccatggattatgtcctgcccttgtcttttccattttaacaaatggaaaacctgaggtagagagaggtcacatagccagaacaaaagtaggtctttctaactcactgtagcttcacagtccacacttgaaaacacctcattagactttatgacatacaaattcattaaattataaaatgaggaaaagagagtaagcataaacaccaggggaacaattaccaatgatgtacaataaatttaaaagctaactgtttttaaagtatattccatgggctgactagatggctaggtgggctaaagtgcttattcccaaacctcatgagctcaattcagttctaagaactcatctggtagaaggaaagaattgatcactataagctgcccgctggcctccacatgtgtgcacacacaaaaataataataactatatttttttaaatctcttgatcatgtatttgagtttaaaatttttattacatgtatttgtttgtgtgtgcttctatcccttggctcaggtgttgaggtcagaggacaactttcacccatatggatttggttctctcttttcacccatatggattctgaggatcaaactcaagttgtctggctcagcagcaagagcctttgccctctgagccagcttgccagccctcaattacctatctgttaaggaaatgtctggatacgtgtttgatgggcagtagaaagcatgctagcatttctagaatacagctttcccatgctcagtggtcacaaaaagcttgtcccttgccagagataggatgtgactcacctggtggcttggaagggtcttttctgggtaagcttcagttactacctgctttggtgcctctcccacaacacacacacacacacacacacacacacacacacacacaaacacacatacacccctctgctcttcaagaaacatcatttttatgttaactctactaaaaccaaacctcaaattattactaagtggactgaaaccagagactgaacctctaaagattaataaaatgtattttgattagcatattcaaaaccagcatcactagaataaataacaaacattcaattatctatttttcacttgtcctcttattaaagaaatgatgtcaaatctcattaccttgcttactcaggagaagaaatccaggagcaataacatctcaaataagcaaattacaactgtatctaagatcaaatttcgggaggaaaatgggagtgcattaagaagatgtactgccacacagactcatttccctagccagatgtcttgatggtggagcaagcaaaaagccatcctgcaaataggatgaatcctaaaacacaagagccataggagtgtgactctgtgcctgaattcaaccacccagggaatgaaggcaaagagcagtaacaggcacacgtcgatccctcaaatttgctgagagaatgaaaactgaagaaagttttcacagaacatgagggaactggtagaaattttcagaacatccaagcaacaatgttttgagttttgacaacatctttcaatgccattataacaacagtggaaccagctaccaaggactggatgaaatgacagactataatctgctccaggaaaaaacaacaaacaaacaaaaaacacctctcctatgcatgcctgatctgcacgtggtaagcaagaaaaacatctctaagctcagctttgcctaagcaagaggttcagacccaaacctacgggtggtataatgtttccagtacaactctaacatggcaaaatttcctgagtttctgcacttcaaatagaccactgtttttgttttagcaccctctgtagaagttgtccagaatgacccaactcttcataacagatctcacctaaggtcacaggggaacaacctctgagctactctgtcccactgaaagtaagacaagtagcatttcaatgaaaccaaatctacacaccccagagctgtcctatctcccaggacattaaagcaaaataaaattacagccagttcagattttgagaataatttgggctatttagcaccctcctaaccatttactgtcagaaaaggggtttccaacatttacaatacgaatttttcttcttgggaatcaagacttgatctcaaactcagagagaactcagttggagcctaaggaccaattttatacaaaaacacttaatcttaaagtaatagtatatcccgccacttaatacccacttaggttttgtttttgttttgtttttttctcacatggcatactaaaggaaaggaagccacaagtatcaaagcacatctgaaatgcctttccaggagaagtcttagccacaagaatagtttcttctgagaacacaataagaaaatacttcagaattttccaaagtacccccatggttaaaaaaaaaaaaaatgcagtgaaaccctagcagggtaatgagatttcacagaccctccattacgcactgatttcctctgtacctttaaacatttcttaactgcttagagggcagacagtacttcagagggaagtcccgtaacacacctgttagagaacctgttcaccgctggcctggctgtacagccttgataagagagaaaacagtcacgtgcatggcaaacactgattgtctgctctccagtctcatgtcgaattagacacaacattcccagaagtcccatacccaagaactagttgtgcctcagtgtccctaaccactaagtatcaggtgtggtactatacaagttctatagtcaaaataattacacataatcacctataaagtccacatcggaatattactttgagatgctgtcagagtacaacttccaaaggcttatgcaatattctcttccttcaaacagtccaatagacttagctcaactattcatcgagataagacaaacacctatttggtttaacagcattgacataaaagttcaagagagaggtactgaaaccttcccaggcaaggttatcagagcttggattatcgtgtccaaagtagatcccatagaacctaactagggtaagcctttgatttcgtttactgagacagcttcagggctgaggaacagaagaggacaaaacacagaaaagcagtggatccattctttataactatttcttgactacttggtacagaaccagtggtcaatctccacaatttggcgtgtgtagagactggaactccagcaggggtcgggagccagaagctggcaaacacagatgttgcccttccaccaggcccacccagatgtaaccaatagacagggcgctgtggactcctaaagaagtctcccttagaaacctgactggtgtctgggaaaccagagcgggtttcctgggtggtctgaacacccagtgtccacagggctcacaacaagggagaatgccttctccgcccgtgacccctaccacccacactccagtattccagcgaaacccttaaaacaagtgcatggattcccacggaatctaaaggcccctcccaaacaagataatcatagatgcttttgtaaactcagcaaacgttttcacaagaaataaatgtcctgagcttgagactgaccagcagtctggggtcccccaagcgcctgaacctcggccagaagcacagatgggaagagggggaccctggctctcatgcgctcccttctccacctcccgcatgccactgacttccaccgctcgcgaagagctgaggttgaactccctcaccctccgcaccggtgcctgagacggtgaggggcagctgctgcctcctccccggtgagctcgcaactgccgcctcagaccccgcaccgccatgcatgcacttgttgccatcccccagagaccaggaggcggcgcccatccctccggctgcccagccggcagggtgcaacctctcgccgcctctgcagacccctgcgtcctcggagaccctggagaaactttgtcccctgcgaactcagtgggcaaacttcacccggggctgcggaggacaccagagggatggctcccgcggtcagcctttacctggagctgtggcccgggagcgcccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgggcggcggcgcccgctcgccccgggggcctccacgccctagtggcgccggaggaaggagctggcctgtcagctcctaaggggagcagtgccaggccctatggaggctcaggttgtccccagcccaaagccaccacacccgggacataatagcaccggggtctgttacaataggaagtactattttaaaagaaactaccctcttaattcatggggatgatgaatgttactctggtccacagcctcgattgcctaggcttttatgcacacaggtgcctaaatgacattataaataaataaataaaattcagggttttgttttttttttttttttttttttttttttttgagaaaggcatagccacttacacaatgctcagcaatgtgaagggaccccctgatcttgctgcacctaattactgagcactgactcaaccccaaggtaaaaattccctccattgtacagctcaccataaaataggtttaagacggtcattacagctttaaagataaaattatgcatctgcttttctgaaattaccttgaatattggctttgtttttctcaagaagatgtctacatcaacatgagaggtgtggtggccccaagaacttgggccaccaattctccaaatcagaagcaggacccctctctaatcatcgccaccaaatgccctggaccaccctcctaatgttccttgtttcaacagagcccagggaatgatgggataccaagaaaagatgcccaggtcctgtcccagcgcaaacgctgctcttctttccccatcaaggacctgacattggccttgcactattgaaactcgcactcacatcaactgatctcacaccgcagagccataggccccaaagagaaccctctccactgaagaacttcaaggtcctgaagataaaaaataaaagcaataatattattttcaaacatcaatattttcaatttgaaaatgtcaactggagattagctgagtcaacacaccggacaaaaacagttttcaagctggttaggagaaaagtgagtaaaagaagccttcattgttgacccctttgttgctgttgtcctcttatttctttgtttttttttctttttcgttgattctgtcatattgccagaaaaaaaagcaaggaattgtgggaagaggaacaagtattgtaagacgttatgccaaccatcttccacactaaaaagaagcagacaggaaaactgtcactaaaactctcagcaggattgtagatgaggacatgtaatcccactagctgcagttgccttgccctccctcaagcactgggcttgatcaatatttaaataagtacttggctttcaactgttctgggttcaaactctaagcgcatgctctggcaacttgaaaagaagcaggtgactgcctgaggcaggaagatatccctgtgtaaataactctttgcatctgattgatttcgctcctgcagacacaggtcactcaggacatggatagcactgagctgggctggaactgcaggtgtttagaattcagacaaagcctgctattctcaggccacagacaaggagtgctcagccagaaagaaagcaggtgggcaattctgctggcattgccccagcttcccagggagtcctctgcagtatcccagctggtctgtcttgtctaacagtccagcctccattcatccttaacctttatgctacccagacctcctccgtaagtcccttctccattgtcctgctttcttccatcctctgacctttgacaaagagtcgtagtcttatcacacggaagagcacttgcctatacttgctgtcatgggcaggactattaaaattctctgatgactagcttgtgtcaagttgacataaacctagacagcacagaagccaatcctaactttctttctaatgctgtggcgaataccataaccaaaagcaagtaggggaggaaaccatttatttggtttcctgatcacagtccataaagttaaggcagtaccctgggggtgggaactgaagtagaggtcacagagggatgctgcttactggcttgctttttcatataacccaagacacttgcccagatatagtagggcacagtagactggaccctcccaaatcagttattaaaaattgaaaacaattctcccatattctctacaggccaatttgatgtaagcattttctcagttgaggttcccttttcccaggtggctctagtgtgtgtccagttgggggaagaaaacaaactaacagcacagagcccaacatactcaaaaccaggggaaagtctcaagtggaacactgtccatgcacaaaataatgtttaccttcagcaaatccctaggggcctgaaactctaacattaatgatttgttccgcctctattgccactattttttaaaataatgttttcaaatgaactttttaatgtaagtataccaagtaatgggtttcattgtatatggaagggactgtttatattcaacacagttctctcttctggctacatattatcaccccagggccccacactagaccataatctccaggggataggacccaggtttgtaacttccccaggggattccaaagtctagaccaagttgcaatcagatgaaagggactgagtttgtcaccagtgcaggagatgaacatcaacctttaatgacacaagggtaagtgacatagccctcctttctgtttctcctgtgttggacaatctgctcagaacttgaggtgtgctctgcttcagggaagtgtgcacatgaatcatgttgggattgtagaaaggcaaatccttgtttaatatgagctgaaggctgcaatgctgcatttctgatgaacttcagaaagtgcccacctgcctggtctccagaccaacctccaggtgtggtagttcatgcctataatccagcaattgggaggttgaagcaagaggatcaccatgagttcaaggcagcctgagctatgtagtaagttccaggccaacctagactatatttagagagagcctgtctttcaaaaagtcatgatagagcaagatgacagtgggcacacttttaatcctagcactcaggaggcagaggcaagtggatctctgtgagttcaaggccatcctggtctagaaatgagttccaggacaaccaaggctacacatagataccctttctcggaaaaaaaaaaaaatccatgctaaacacctgtaacccccacacttgaaaggcagaagcaccagtctaggttggattagccacctgccttctatacccagaattgttctgggatatatttgaatagaagctgtccacaaaagaagagttctcaatggctgttatgaaaggaaaagcttattccattgttctatgtgggatgtgtgtgcagctcatcgcaggtgagggtcctagccttcaaggtacattgctaggcaaggatatgtgtacatgcaggagagagtgtaggcttccaagtgcattatagaagagggatgtgtgaaccaaaagttcaagaccacccagtctacacagcacaattctgtctcaaaatacaacaatgcaaaaacaaataagaacagaagttcaaaatagacataagggacaagcagagaaaaagtcaatatttgctaccaaagaagtcactacctcagaatatttttagtcaaataatagtaactgctaactacccacaaaatgcatatgttacaatctttgtataaaagagatcatattttgccagttttaaatataaaatctttctgacagggaaaacttctattaggcaaaacctgttttaaacaaagttacttttcaaggcctacaaaaatgttttaatttttcttgaacttggaagtaaaacatgaacttttaggtcaagaaaaaaaatgtcttaccatataatattatctttatttgcagtaataaaatatttcttattttaatttttcaggaggaggaggcctacgaagctgaagtgcacagagcccacagaaatctcaatgcacacaagttctcaaagtccatgttcgtcccaggtagttagaaaagcctgtagaccttcctatcatggctgatatttgcatacagctgcttacatgagtggcaggaagatattagggaaattataaatacacctcttgagtagaaccaaccctataaatatacaggatttgacagttcccacacatgcaatttgtgaaacactgtccatgcacaaaatattgtttattcgtctaatccctagggtcttaaaactctaacattaaagatttgttccacctctattgctaccttttttagcttgtgactggtggtcctatctggacccagtctttccaggttctttttgtctcagttaaagaattaaaatacagatgcacacagattacagagtgagaaggaagcttcattcagaggcaaagcaatattacatctccaatattcggtcaaagagcagaggccaactgagtgaaagagcattcaggggcagaggcattgtttggggcttcattttgtgggctctaggaggaggatgggcttggatgacagggggcttgggagtgtggttctctgttttggctgacagatttgattatgtaagatttttttttcccctctgagtgttctttcccacaatgcatccacaccatactggacactctgctcttttttcaagttcccaaaaagactgcctggaagtgcctagatcaaacaggacttaaacttgaagtaatttttctgactggctcgacagtgccaggattacaaacatgtgccaccaaacctgggccttgaaacaccaatttcgattttctgtctctcaccctttgagagctctggatcattctgacttgtgaaaagctatcaaatcctaccagagatccatccaaggaaccactgaggtttgcaaagaagtctactctaaggccgggcattggtggcacacgcctttaatcccagaactcgggggaggtagaggcagacggatctctgagttcaaggccagcctggtctacagagcaagtgccaggataggctccaatgctacacagagaaaccctgtctcgaaaaaccaaaaaaaaaaaagtctactctagaacagactttatctcagaatatgattgtttgctacactgatgtgcatgcttgtgtgtgtgtgtgtgtgtgtgtgtgtgtgtgtgtgtgtgtgtgttttcttgctaaaatggctacaggtaacttcctgttatatcttacttcttaaatattaagctaatgtaagaccccctttttgatctccaggcataactccacaagacagtccaaagagatactcttaaaagcacgctgtgtctatgtatcttccatcagtcatcagatgttccagagtgctccaatgtgggtgtgtaagagagaactacatgtaccctaacacctgtccaacactgataggaacatgttaaatctcagcctgaagcaagctttcacggttatataataaaagccctttttaaagagttgataattgagacactaacaccattttaattagggtggcacaactagtcactgattatacctgtgggaaataatgggtacgaaaatgtcacatgggctgtaattatattgaaagcttctggtgactggtgacatgacagatgtgagaatgaggccctgctgctctgctcatgacgtcatctgaacactgctaaatgcatgtgtggctctgggtgctcttactcatcacagacaatccagttcctggtttcctatttacaaagggcaggcagaggaagggaccagagaggaaactccataaacaaaataaggatgaatctgtttccctcccacaagaagttatataaagtattttcactaagcttttcagacttcatttgaatacatctgaaagcttctaacatagaatctaaattgaaatcagatcctgccataaacggatctcagaacttttgtctaacccaccttaactaacctgcaatttctaaagctaatttaaaggacctagagtcagggttaaaggcaatgcaccacagctgccttgtttctgttttcaagtctggaagatctgtgcctgttcacttggtatagcttcatctctaacactcaaagaaggcaggcagggcaagtgagtttacagaggcattcacacttcaacccaaccaaaccaacttaacaattatatgtaatatgcagaaaaaactacacacttcagtaagcactcacattgtcaagagaggagagagagagttcaaatgaataacataatgatataccccaacggtttagaaaaacatgcaaaagccaatccaaatgactgcaagaaataacaaataaaaaagtattctaatcaataagtagactaatgaattaaatagacagttctcaaaagaaaaaaaccaagaaaccaataaatatttttttaaagtgtccaatatctcagacatcagggagatgcaaattagaatctctgagaggccatctttcgccaaatcagaatagtaaacatcaagaaaacaaatactagtgaggatatggaaaaataaaaccattactccttgctgttgggagtataaagcagcacagctagtatggtattcagtgtggaggttcttcaaaaaaattaaaaatagaactaccctataggccagctctatcactcttgggaatatactcgggggagtctaagtcttactagagaaatgcttgtacatccagtttatacctgcagtaggcacaatagttaagaagaagcctaggccaccaatagttgaacagataaagaaaatgtggtatatattcacagtggaattttattcagccaaaaagaagaaaaacaaaatcatgacatttgtaagaaaaatatggaaactcgaaaacattttgctaaagaaagcaagcatggcttagaagagaaaataccacatttgtgtgtgtgtgtatgtgtgtggttcctacattttgatttttatatattgggggggcatgagccatgaaactagaaaggagaccatgagaggggaaaagagacctgggggcagaaagagagaaaaagaaggcaattgaattcatgtcacaagaaagcataagggagctactggagagaggaagggggagtgtgggagggagaagagggcaagagagggaagtaggaggggaatcttgagggaacctatgggccagtagaatagtgaaaagaagataagagaaggagctagaggaggaaggacaaagtggtgcagcaggctttcttggactgccagcctccaaatcacaattattaattgtgaatgctcggccttagcttaggtatgtttctagctaacctttttctttaacttatatcaatccatttctgtcaacctatgtgctgctccaaagcttgtttacctcatctaagtactgtccatcctgcttccctgcttcctccatgtctgtctgtctgtctgtctggcccctggctaactggctcccctttgctctctgcccaccacccccacctatcccttctctgcctaactattggccattcagcttttcattagaccagtcaggtgccttaggccagcaaggtgaaacagcaacacatctttacatagttaaaacaaaaacagcataaacaaaagcaatacctctttacatagttaaacaaatattctattctacaacaaaatgggcttagaaatgccataatgaaacccattattttgtatgctaattttgaaaattaaaaagaaaagaaaactatggtatttagcttcaggatgaagctaagccatgaaaaatgaaaaccaaatactgtgtgagattaaaaaaaaattcttattagtatattgtggagatgcacaagaaaactatgtatctataaaacaaaaacaagtcactgtgaaaaaggagtcatcagaggacaagaaattaaaaataggaaatagtaaattttaaaagtttaacacagggttgatgataaagtcatagaaatgtcccagaaagttgtgttgtgactatttttaagacaaatgcacaggactgaggatggcttcccatttgtgtttctctctctctctctctctctctctctctctctctctctccacacacacacacacacagagagaaaatatgaaataatttttaataaatattaatctcacctaacatcccactaaaagaaattctaagtgaagaaagaaagggggaatgaaagaaatgattaaagaacatttttaagctcaaaattcaggaaaatgtgtatgtctttgttaaggttactattgattgctgcaatgaaaacaccatgacccaagcaactagggaagggcaaggtttctttggcttacacttcaatatcactgttcatcactaaaggaagtcaggacaggaactcgaacagttcaggaacctggaagcaggagctgatgcagaggttatggagggttgcttgctatggtttgctatggcttgctctgcctgctttcttatagagcccaggatggcaccactcacaatgggctgagccctgccacatcagtcactaagaaaatgccttacagccagatctgatgaaggcatttctcaaccaaggttccctcctttcagataactctagcttgtatcaagttgacataaaagtagccagtttacttctaatagatcctcaagacctgttaagagtgttaaggtacacagacaagactgtttgctctatacaacacttttgaaacagcaaaatttgcaaacaatgtgattgttcatatggttgtttggttaggtaaactatagaaccttcgtcatgcagttgttttaaaatactaatgtgaggctggcgtggcccagggtgagagcacttgctgctctaccagagaacccacgttttatccccagtacccctgtaagactattcacaactgctggtaactccagttccaaatgatcctccacctctagcctctatgagtacctgtactcacacacaaatacacacatatgcacataattaaaaaagaaagcaaatctttttaaaacgcacaataaatacataacaagggaatagaggcaaagatccatggtcaagcccccagtgttgcagagtgaaaaataaaacgagaacagggcagtgtttataggtgtctgtgtttgcagatgtgctgtagcgggcctagaatgtcactgagaatgtatcaacacagtgacctcagaagagaaacaggactcaggattagtgaacaacctttaacagtagacacgaatgaatgaatgaatgaataaatgaatgaatgaatggatgaatctgatgatttatcctattctattaatccactgccaacctactatagtactctttttaaaaatttttttatttatttaatttttcatttatttgtttgaaaagtatgtacatgcatgccacatgaatgtgtggatgtcagagaacaacttgttctatcatgtaggtcctgagaatcgaactcaggtcatcaggctagacagcagatgccttggcctgctgaaccatctcaccaaccctctcaacagttctctagagaagtgtgttacccttcagctctgtcctctttatctacagggtagtgcagacttctggtctttgtgtgctgatagaattggcttttcatccatgtgtcaacagccttgaagacattgctataacaacaactttcacactatgctttagttggttgcttgctattttgcagatgcagtggttgagtaaagggcagtgtgcactctgccattggacataattgacattctgcttctctgttcttttaacaaatgactgtaactcactaagttggactttcctcacccttaacatgaaaaccctcataggagacttagcatcttttagaactgtgatgaagactggagcctggcactcagccagaatgctggacaaggcggccctcattattattgctttgtccttgctggacaacagttaggtaagagcaaggtcggcttcgttgtcttcatatgattccctagtgtctatacaatattgatgcccattttagaaacctgaatgtcacctggcaatcctttagaaaagctctgaaaaactggcatgaaagccagagtatgggtcagtgaacaccagccccaccgtgatgtccatgagtcaggtgggaagctataggaatgataccactcctggggataggtggaattgcaggattctccctgtggggtattcaagggtctagggttatagacatcattgctgcttcttttctgtgttaatatgttggagcttaatatgcattattcatattagcaatggttccttcaggtgaactctggtcagagggtttgtggtaggaggtttcctgataaaactcctatgagatggtccattttagttgcaaatgtggagttgcatgcctgcctggccagtaccattatgtgtccattaagtgttgtaggcatccaactatacacagtaatgaggctctgtgtcttctgtaactgctgcaaaagttcctaggactatcacttgccttgcccaagcaacatctgaagcatggggcatagccctacctaagtatttggtgggcacctctctgtgctcctcctagcctgtcatcatttgcctctccctacatcctggcatatacccactgcagcactcaattgcaaagtgcaaaagaactcatttcttttctgatactctgcatgagcccatccacaagttcccccctccccatccagctgctacctgatgttaagcagagctatctggagagctgggatctggacagacacatcgctcagaggctgattcagcagttctggtgcactccaggaaattcctcctagggtgatctatctgctaggtgcttctccaattctgtccttgagaaacaccaatgtgaaccatcctcccttcctaatagcaacacttaccagcaccttctggagagatactgtccttgggcaccattttcagtcacctagtcctgctgagaagatgttattgaccacagccttggacacgatcctggaattccatagtcagccatggtgtatacctggcacttaaccctccaccacaccaggagatgccagtagtggcttaagtgagggaagcaccaatgactaacaaagcctagagctacacccagcctatcccttctccaaaaccctgtgtggcctcatgtggggacttttagaaaaatcgctagagtcattttcttctgaagctctaactaatacaagctcctgtgcagaccactgctaccctgatccatctggcttcaccaccaactccagctcccccacctcttctgctctgccaacacaagttctgaaaacaacattgctgagctcaatgtctttctgccaatcatgtcagcctccttccagcagaggctcctcaacctgctcatccatgcccatctggggtagatgtcactagctgcacaccccctactctgtgctttctttggcctttgggtttactggccagcatccctggaactgtctctgactcggtctacctcagcagagcaggccctaaggtgatcctggctggttgttctcttctgtaattgtccactgaataaacaatgtaggtctcaaccacccttctgaccctcacctaatagaaaaggcttatgctttgtctctggtgtctggggaaagaaggaacgtcttgtaatgggcccaatgtctcaaaaaccttcagactcatcctttgcattgcttgctacgttcctgagagacttgtattctttttcttcaactgaggagccaggatacaacggtcttccttaacacggaaaagatgtcttcccaatcagactccgaggtgagcatgtctgagaagagtgggaaggcattgtataaaacccttggctgcagaatgcctttcacctttgctgccaactgcatggcaaagtgtacagatcataagcaaacagcacgccacaagatgaaagccccaagtgggaaagcaccattgctcacgccaaaagcatatttgcttttctgttggcaatggagtgcctgccattgtttctccaggagttaaatgtgtcgtgtggtacaatgccatccaaatctgcaccccggcagcaggaaagggggacgggatgacacttgtccactgtgtgggcacgtttctctaaaatgaaggcttggcttgtgtgtgtggcagggaggactggaggctgacctcctctgtaaaggctgctacacttagcatctcatgttggaggcaacaaaaaggaagtgtctacagtaagggttcagtgaaggaaaagaagggcagtcacaaagccatgtgagagtcttaagaatgcccaaattgggcgggagagccaactcagaggtcaaaagcacttgttgctctttcagaggacccaggtgcaagtcccagcacccacattacagttcacaactgtctgtaactgcagttccaaggggtccaacactctctccgggcctcgatgggcaccaggcgcacatgtggtacacatacatacatgccgacaaaacactcatacacattaggtaaaactaaataattaaaaaaccaaataacagggagctggagagatggctcagtggttaagagcacttcctactcttccaaaggtcccaagttcaattcccagcaacaacatggtgactcacaaccatttgtaatgagatccagtgccctcttctgacctgcaggcatacatgcagacagaatactgtatgcataaataaatctttaaaaaaaaaaaaagacttcaaaaaaaaaaaaaaaaagccaggcgatggtggcacccgcctttaatcccagcactggggaagcagagacaggtgaatctgagtttgaggccagcctggtctccaaagccaggagaggttccaaagctacacagagaaaccctgtctcaaaaaaccaaaaaaacgaaacaaaacaaaacaaaaaacaaaaaaaaaaccaaataacacctatttccccctccaaatcccagagaacatctcagaagaggagacagagagctgtaagagctaaagagtgagggaaagtgccatgaacctcttgaatatcctttgggattatcctctcctctattattaattcattcagtagtcactgagggaatcttactgatgataatattctcctatgtccaagcacagttactgctactggtattgcaggaacactcggagaagcttgcattctagtgagtaagagcagatagtaagcaaataaatcaactcaataaggagacatacaggatgtcaggtgagtagggaaaaaaagggggaagtgctaagggcaggcagttgagtcacaagcttgagtgggttgggaagagaagtcctcttacaaatgaaaaagtgacggacatttgaagagaccagagcatgcatgcttctgatacccagatgtggagggagggtgtcccagagcatgaatagcaagggcaaaggccaccaggtaggagcatgccctagaaagcgtgtgggcaatgcttagcacagtgagctccctaaggtcattccctagcccaacaggaaccacagggagaacactaacttcatgctaagcaccccttgttcatatgtggtctgcactggggatctgggcaagcctcctgggaacatcaagcttaatttatgcaatattagacatctatagataaacctccttgtttctccaaatacatagaggatttagttgcttagcaacaaaacatacacctaaaatacaaatcaatagagctttgattatattaaaacttcagaggggattattttggcatcattgcctctcttataaatgttttcttagaggcagtcataaaattggcatttgagggaaggcatttccgtgtgtgtgtgtgtgtgtgtgtgtgtgtgtgtgtgtgtgtgtgtttctttactaaacattcagagctttgaaaggggagatttatcatgacatagaatttttcatttcaagtctctgacttgaaataaaaaaaggaaatttgataaatgtaggtacattaaaagcagcagtgtcgtacagcaaaataccatgaagaaaattaaaaaggaaattggaaaattagaataaaatatttaaaacagagaaaaagactagtatatgccatatgcaaaatcagttggcaaaatcattgccacatgagcatgagaacctgaattcaatgcccagaacccatgtaaaaagccaagtgtagtggcaggtgcttccacctccagtgctgccacaatggggactggcagatcccccaggctcactggtcagcctgcctggcacaaacagagagcccaggccagtgaaaaaccctgggcaacaaaacaaggtaaacagtgcctgaagaggtcagggcctctgccctgcacacacacacacacacacacacacacacacacacacacacgtgcacaaacatgtatgtgcagatgcacatatatgaccagaacatgaacacatccatcctcatacacacaaaaaaaagaacttttgagaagcaaaggacagaatgactactagaaaaatggagacaaatacacagacagttcgtataaaagatacgaaaatgtcccacatacgtatgaaaaatgtataaacaactacctttagaaaacttcagtgctagaatgtcagttctcacctatcagattgggaaaaaattaagagcatagcatctcatggtgtcggggaggcctggaggtcattctcttgactcactactgggagtgcagatggcacgatgcttcttgggaaaatcaggcagtttctcagaaactcaaacaggacccatccatgtcacttctagaaacccgccctcaagccacagcaccaaaagcacagacatatctttttaacattttatttgttgtgtgtatgtatagcattactgaaatccatctcaataaacatgctcatacgagtagctaaataaacgatgatatcgccattcactgaattaaatagatgacagtatatccgtcactgaattacttagcagcgtaagaactaaggactgtagtctagaaaatggtattattctggggctaaatgagaaaagggaattgcaaaaaaaaaaaaaaaaaaaagtttttataatatgctaacttttgtgtaagaaagaagcagatatgaaaatacacctgcatctgaaaatctatgaaataaaaaatgcagaaattaaagaagctgtctgtctccaaggatgagtagaaaggggtaaaaggatggggggtggagtagtaagaataagctgggagctttcattcttaaaatcatagtaatggtatgtgttttcccaaaagtaaacaatacttaactaaatacaaccaggatgtggagagaacctgaaatgaaatccaaacagtaacagatgagatcaatcttacaagtaaatgatagagttacagtgggggagatgcgggatgtggagtcagtccaggaactaggaaacgtcatactctctgaaagcaactagacaaatagtgacctgttgttggttgtttttactctttagtcttttgttctcttctgaggggcctgccacccagtttccaaataaataccgggtgttttagacaggcaaagtaacaaagcttcacagaggtaaacaaatgcaacctaaaggaatgcaacaaatctttgcatcattaaacaaatgttcctccgcataaacaaatgtaacacatctttaactaatattctgcaacagtaacctattctagtaaatctacttctcattggaggatgaattgataatgctgtaacttcttaaaatatgcctggtagggaccaggtgtggtagctcacacctttaatcccaacattcaggcaggcagatctctgtgagttcaaggctagcctagtcctcatagtgagctccaggacagccaacactacataatgaaacactggtacacatgtagtgtggtatgtgtgtgtgtgtgtgtgtgtgtgtgtgtgtgtgtgtgtgtacaatatttgtagtgtactctgtcccaagggcagagagagaagctgtaaatatgttatgaaatatcacttggacttggaggagtggaaggaagccacagagcttcggatacataggtgtccacatgagcagaatgaacagaaatgaacaggtgaaaacatagatatttgtgctagaatgcatttcctacttcagtccattagaagagctttagagcaatgatcctcttagaggccgtacgtattttcagggctcccatcctgaggtcaaacatcactctttaacacaaagagaattctttggttctaggactgaagtaggaaaaacgcaaattgggccaggagcatagtatgataccagcaagagaagaggggctttttttaaaaaatgaaggaaggaaggagggaaggaaggaaggaaggaaaacatgggcaacattatggtgatacagactgtaaccttcagaataaagaaaatatcttaagtccgtacttagggatgaacagaggagagacaacttctccctataaagaattccaacaatgaagaaatggaaattttcatctgaactccactacaatcattgctgttggcaagatcagaacgtgctaaaattagtgggtgaaaatatagtcatcaacatgatattcctgccaaaaacacatactcggaatctagtggagagaaaacatcagacaaacccaaactgacagacatgctacaaaataattgaccagtagtcatcaaaagtcacaagttcctgggaagccacacatttcaggggtgctaagaaaacatgacagctaaatataatgaaggatgctggactagatcctagagccgagaaaggacagggcagaatggactggaaaaaccagtatgtctgagtgaacagcattagaccaaagttgattgctggttccaggcatccggctgtggctatgaaagttgttaacctgaggacaggctgtccgaaacctctctattcttggcaatgtttgtccatcagtcaaaaatggcttcaaaataaaactacattggagttgaagactctaaagccatctgtgcttgaagctcccacttgtatctagttctccacacagcagagacgtgtctccttgtcagtgtggacagagcaagtgcctgcctctgccattgctgctagtcccaaatcagatatttgcccctcagaatccaactttcaagagcaaacatttattctggctgagtgttgcactctggacatgaggctcctgtggaccctgtcaccatgtatctatgtccactatacccctcccttttccctttctccagcttttcatgggtagatccagataacccataccctaatctcttagactaatcataaagaaatccataggtaactaccccatgttactattataaagggatattggtgatgctgaaaattaaattcatatcctttgtctatcaagtggccttcatgtcctatttgataagagaaatttgaatcaataatgtggcctatttacatgaagggacagtgttttagctatgagtacagcctactactattggggattcctgtggaagagtttagattcaccttgtgacaaaccggaaatcatctcatcaacataaattaaagggcagggagagtgggccatggggacagctcagtgggaaagtgttttctgtgcaagcatgaggacctgagttcaaatccccagcattcatataaaaagccacatgttatgattcatgcctgtaatcaaagctctgggagctggagctccacaggaggttagggggaacagttcactggacagacttctgtgagctccaggttcagtaagaaactgtctcaaaatataaggtggaaatcagtggaaggagtcaccaacattgaaattgtgtctccaagcacacactcaagatacacacatacacatatacacactcacacacacaataaagtatctttgctaggaaccctgggcagtgattcagaatgttttaacaaaacaagaaaatatcttaaagtagaacttcacgtgagcgtggtgatggaggtgtaagtcagagttcccagctaagcacttcaattgcgctctgttatgttgtaaataagtaatgccctgaagacccggacactgaaggcgtggtccccagctggcgtatccagggatcacaccacaagagctctaacatgaccagtgcagtgattgatggatggcatcataatctgatggcattattagaaggcggtagattctggatgtggggcccagttgcaggaagtagatcactgggatacatcactgaaggatatttggtccaggaggtccctacctctctttctctttctcttttgtccaccatgaagtgagtcactttgcaccaacacatgcttcctgccaaggatattctgcccctccatgaatagtcccagaagcaatggaacccagtgactgtgcgttgtgagccgtgttaaatttttctcctttaaagtctctctcatgttcttgccacagtcatgaaaagtccaactaatattctctccttgtaaaaacagtggtgatacccatttcttttaccttcttggcagctgttgtaatagcatcaaattctgtaacttccatttattagagtcttcactccatatctcagcactaagacttggttttccatatttgatagcataaagctattaaatccttagctcttttttttctttgataagtttttgtatgttttttttttagatgttctcactttgtagcccaggctgctcttgaacttgtgatcctcctgcctcagcctgctgagtttagctctatttgtatatattgacacaatggactgaagggaagatcaaaatcacttacttcacaaactactaaatgctacctttagaggaatacgacatcctagcatgggataggtggcacataaagtcagtgtgctcatttgagtcattggtgggaagcctaatggcccatttaggggaactgagtctttcctaaaaatccatatggagggggctggagagaaggctcagaggttaagagctttggtagctcttccagaggctgagttcaattcccagcacccacatggcagctcacaacttcttgtaactctaccttcagggaatctgacaccctcctacaggcatacatgcagacaataaataaacgcacaataaataaaaataaataaattattttttaaaatccatatagaaccaaaagctacagtagagagggactgaagattaagggactgtgtagactaaatacctgatgacttgggatgacttccttctactcttagccctaagacaatgttgcttagcacccaccataataccacgcagcttcagaaatgccatctcccctcctgaaactgactaaaatgactagggagaaacaatcctgctaaagaaacctgacaccacaaactaaactaatttcttcccaacagaatgaagtctggggacattgatgaaaacaaccaaaaactgactcacagaaaatgtgctttccaactcattcagccacctcagtacgattgattcagacaccaaagccaaaagaggcctcacagcaatactattactcagtcccccttctgactgtaaatgttaaaatccttggttgaattccagcaaaacaaatctgtgtaaagcattatatactgtgaccaagaggaacttatcccaggaatgcaaggacggcccaccatgaaatgcaaggacagtccaccatgaaattgaaggatgtatggtccaccatgaaaggaccaatcaactctacatcactaaaataaaggagaaaggccacactgtcatctcaactgaatgaggaaaagcacccgacagaacctaatgctctttatattcactaggagcagaaggaaacactcccaactcaggaaagactatgtatggaaaccccaaagctagagtcatagttaacaataaaaacctgaagtctctttccttcatgtcaggaacagaatgagatgtctgttcttgccctttctagttaatactgccctgggggttctggccagagcggttacatcaggaaagaaagccaaaggcatctgtattataaaggtaaaaggaaaactctctaattccaatgacatgcttttgtaaatagaaaattctaggtaatcaactaaaaaactctttgaattagcaagcaattttaacaaaactgccgtttataagcgcaatataaaagtcagttacatttccatatactagaaaacttatattcttgggataaagcccattcttgtccagattaagatcagtaagaaagggtcaatgagacaacccagacaataaagatgcttcctggctggtgacctgaattcaatccctgaaacccacatggcagaagggagctgactcctataaactgtcctctaccctccacatacacatgatgacgtgattgtgagtgcgtgtgcgcaaatacacacacacacacacacacacacacacacacacacacacaccaacttctagtaggcgattagagcaaggtttctgtgtacacacttagcccatcaaggagcagttagaatgttatatcacaaaataaaatgcttatgcacaaatgaacccaatacctataagatcaatacagagaaagctacaaaactctgatgaaagaaaccaaagaaataaatgagactgtttcctagatataggaaaattcagcaaataccatgttatgggggctggaaagattgctcaaggttatgaacatgtgctgctcaggcagaggttccaagttcagttcccagcacccacagagggcaggtcacaactgcctgtcactccaactccagaggacccaatacactcttctggactccaccagcaccaacactcacacatgcatatgcccacaaacagaaacatacacacgtacacataattaaaaagaaaagaaattcttaaaataaaatcttatgcatactgacaagtgtattccaaacttcatttgtcaaagcaaagaacccaatatggttgaaggagtaaaaaaaagccaaggaaccatcactacccaaattcaaaactcatggtaatggagcagagtagaaaacccaggaataaacccaaatagacaggatgatctgaacattagttacgaggcaaaggcaattccatggaacaaacaacaacaacaacaacaaaagctatttcagcaaatgggctgctgaaataaatagaatgtgaatgagtatttcacaatgtggacacagatttgatccctttcagaaagagtcaactaaaagatgaatcatagacacaactttaaacatcatacatagaaaacagcatgggagaaattctaggtgttgtgagcttgaccatcactgtttagatggaacattaaaaacacagcccatgaaaggagaactgatgttgggcttcattcaatttaaaaagctgtgtttgtgaatttaaaaaaaagtaaataaaaagaaaagccacaggcttggagaagatctttccaaaacccatatccaatgaaaaactggtacccaagacaaagaacccataagaatgtatccctaggtctggagaaatggctccatgctttagagcactggctgctttcccagaggacctggattcgatccccagcacccacatctataactccagttctaagggacctgatgccctctgcacacactgccttctgccttctggcctctgcacacactgcacccatgtggtacacagacacacatgcaagctaaacctccatgcatataacataataaaattaaaaattaataaaaatgaacttaaccataaaaactcacggttattattgtaggaatgcgaagtgatacaaccactctgaacagcagttgcccattttcttatagaattaaatacacatttactatctcttagttgaataagtaccaaggaagtgtgattgtaactgctaaaacttgcaattaaccagaatttccttcaataggtgaaaaattaaactgtaatgcattcatgcaatgaaatattattcagcaaatttttgaaaatgggctagtaagccatcaaaagatacatagaaaacctgattaaatacatctgttgactgaaaggaaacagcctgcaaaaggcatgtatatactgccagcaattctcagatgagggtacgtatggctcacttcctccaagtgtttggggacactgctagactaaatagctttaaggaacatttatagcttaaaacatggttgttgatttttttaatattttctggatttctgagtgttgctattattttgctttgagtatttttagtctagcttcccagataccacaaggggtgtgactttgctacaccatgatgcacccagggcaatcagacaaagcaatcatggaccaaaacttctgaaatcatgagtcattaactttgcattaatctttcttctttctatatggtttttcttgggaatctgatatagccatggaagtttaccagcacaaattctcaaaattttagtagagtatcaaaggtttaattcatgcttatatgttcatcatggatctgacgtctctccctgtcccatgccacctcccctatgaaatgagatgatttttgttttatttttatttttgagacagaatttctctgtgtgtaacagccctagcttccctggaactagttctgtaagttaggctggccttgaactcacagagatccacctgcctctgcctctgcctcctgagtgcgggattaaaggcatgcacaatcaccacccaaccctttttttttttttaagaaatttatctagcaagtggctttgctcatggcagtgatgaaaaacttgattttacactttttttttttttggtttgggtggcttgcctacatatacatctgtgcaccatgggcatgcctagtactggagggagccagaagatgagtttagatttcatggaattggagttacagatggttgtgaaccaatatgtgggttctaggaatcaaacctgggtcacctggaagagcaaaaagtggtcttaacctctgagtagtcatctctctgtctccaagaacttgctatcaagcatctgcttatatttgcatggcatcacttctgctctgattccatgaaataagtcaaatcacacctcctgacctcaaccaagtggagatatgtgatcctcccaaacgggaagacacaaggcccaaggccaattcaaatccgataaggtagagatctggaatagacacaacaggatctacaaatgcatggaaatagtgtgacctatgaatgaagacatttgtcaggcttctctttatttggctgactttagaaactactgccagacattttctcctttaagttctagatctatttagatggtatttggcttgaaacagttaaataattcattagcgcaacactcaaatctagggcaggcaagatggcacttgccatccaagcaagacaacctgagcttaatcctgagaatccacatagaatctagtggtttgtattcaaattttagccgagtatgtgagactaatgagatggctaagtggtaaagtacttgccactccggcaagaaaactggagtttcaattcccataaatgacaagaatgctggatgagtggggcagcccacctataattccagttcctgagacaggggatgggattccccgtgtaaattagccagtgaaactagccttatgggcgaattctgggtttaactgatagaccaggcctcaatgaataaagtagaagagctgtgaaggaaagattccctgtatcatcttcaagccttcacatgaattcacatacaaatgcacccgcacacacatgtacccatgcgcatgcaaacacaccacacacacacatgcacaagaaaagcatcccgtggtccagtttctgagattcatttccataaagttccacatattcttataaactgcttaatcttcctctggatatagttatgtcttgcattcaatttttattaaccagtacagcacagcacacatgcttgtgcaacctgggatggttgtgaggttagtcatatgaccttcctgtggcgttttttgtgaagatcaaacaggtaatatatgcactggtgagagtagctccttatccagctcactattagtgtttgactctctccttatatcgtctataatcttccagatttgttcttgttcatttattggtttgtctttcaagacagtttctctgtgcaacctagacggtcctagtactctctccatagatcgggctggcctcgaactcaaagacccacctgcttctgcctcccaaggcatgtgccaccaccatctgactcagatttgttcattttttacactttatcttagggcagaattatatacattcttctctaagagctggccatggagttttaatggtgactgacttctcctgtgccaatgaccttgtactacaatggtaagttaagtaaatagaatcactgggatctgttcaagggtgatgaccttaccatacaaagcatgtgtaaatgcaatgtctctgggtaaacattaataaggaaattaacatttgctattataatttcacagcacaatatctatgttgttctttccccaattttttcatgacaaatttaattccttctgcatctacttccaccaaaagataaaaatgatgatgcagggaagccataaagtctctcttaacctggccacaggaagaggaaaaaaatctggccattgattcccctttgtttcctatgaggaaaccgcttttagctcattaacttctcatttttgtatgactttgtcaagtttatatctcttatggtataggtcacaaagctagaaatggggctatgtaaagaaaggaagagtcttaagggaggtaggagaaagagggtaatggaatataagaaaatagaagtggggattaacttgggaagccagacagaggcagagaggggaacggaggagaacaaagtataccagtatatatacaaagatgccatgatgagacccgttacaatgtatgataatccaaaacactgatttagaaaagataatgccttatagtaatgtttataggaaattaccaaactcattaattagcatagcttatatttttaaacctttagtcaataaagctgtcacatatccaagataatatggttaatttgaaatggaaagtcttattaataaatatgtttgaagaagacaacagtgtcattatgatttatctgaaacatcccccagaggctcatgtgttctgacacttggtccccagctgctggcatccctttatgaggttattgaacttttgatatgggggctctagctgctggaagtgggtcactgggtgagccttgaaggctatggctcccgttccaggctcatggtctctgtgtcctaggcagtcatgatatgagggctctccactttacactctgctgctaccagatctgctgtggctctatgccttttccacatggtaaagtgtgccctctaaaaccatgacccaaataaacctccctgctgttcttaaattccttctcttgggtcagagcattgaggaaaagcaacagagacaagtgtcatcaaatttcctaccagagcatcaataacctagtgagaactaccttcttgctttcttcttctctgttcagactgccaaccataccgtgtacttccaaaattcttgttaattcggtcaatcttaaatcaggtatatgctttttttcctttttgtttacctcattcgttcagaaaatattcacaagagctgggtaagtgactcagtgtcagatgcctgcctagcacatatgagaccctgaattcaatacacacacacacacacacacacacacacacacacacacatttataataatataaaagaaaacttgaatttaactcttacccaagagaaccagataatgttagtaataagataagctaagaaaaagatcagacaaaaaaaaagtgaagttttctgtgtgtcaccacacctctccttaaatctacttggtcagcatagcaattagaaaaaagcttgcgtcccttctgaagggactgtcattactccctgagaacctaagttctgagaagggacagaagaggggactgttcctcacggtttcctaaataacactgcccccttgtggtctaatcgtgagttgtggcaccgtttcaatttctcatgatcaacaggcagtaagaattaacttccaaaaaggctttctgtttgagttggatcttgtagagcgaagaaagctatctccatgttatcttacgcattctaaataaaatatttttctacaaatcagccccaatgacaattcattcattcattcacttggtaactacgtagttaccaagcaggagacatattgtgcaaaagttactatgagagtgaataagaacattctgtgtttatagaacatgagatgttattccttcactgcttgaaaacacacacttttaaagctgtgtttgagctcaatccaaatttgccactaattgtgtgactttggacatgtcacctaaattgtcacccaggtgtctttgtgtgcagaactggatatcagcattgcctgcttcatatagatacttagtgctctgtgaaatattaagaggtttcatagaaactgatattttctcagatgaagaagccttggggaagaggggttaccaggcacagtttttgtggtgggagaaaagacgcattctccaggatccatgttgataatgttcgctcctcaaaaatcaccaaagcttaggtaaaacattgctagatgcgtaactgcttgtacatataaaaacctgaaagccaggtgtatatttgcctgtagatacaaaactctgaaagctgtcagaatgcccatctatggcaatcaactatactgattgtgctacatctgtacagtgatgtcgggaagccagcctaagaaaggatgaagcagagctgtatgcattgggatggctcagcctcggtgcaacataaacagaaaactggaatgcacaaccacaagctgtgtgctctcatttgtttaaaggtgagctaacacatgcaactgtattcaaaggcgtgccgactactgggcagagaatattgtacttatcagtgtcctgaccgccttaggatgctagaatgtcgtcagaacttaggggctggacatttaaagcctttgcaaatattgcccagatgaaaactgggcttctagaggagatggatgtgacagttaatcacatatgtgggttgggaatcacctagatggcgacctctgcatgtcatgtctctgtgtttaaagaggtttgacggaggagagaagacccaccctgaactcagtggcaccatcccatgggctgtagttcaggactacattacaaaaggggtggggcagttgagaaccagtatgcatctctctgattcctgactatggaccagtgtgagcagctgcctcacactcctgccaccacagctagagacactcctgtcaccttgcctttcttgccctgatggacctacaccattgactaaaataaacccttccttaagttgcctgtgtcaggtaatttgtcatgagaaaactaatacatcatactaatacatgatctggaaagcaggggtaaggaaaagccagctttctgcttgttattgtcctcaaatcaggagacagaagcagagaggtgacagtggtgaagtcactaggccacccaggatctattctctatcttgcagatggaagaagtcatggactttgctttctgtggctgtattcttaagcagtggctccattccaaccctttgatgtcacaaagacctggttccctaaattaaatcttatctgcattcgcttctagcactggacagttagatacttagaaaacaagtatttgctctgttgtggttaatatgaactgccgacctcattttgaaaggcagcccagatagctggtaaaacattaccatgggtgtgtctgcaaggtgttctccgaacacattagcatttcaatcagctgacctagttaggaaagtctgccctcagtgatgtgggtgtttcttgaaggcccagaaagaaaaggtaaagaaaaggcaacttcccattcttccaagacactaaagctacaggctctccaacctccaaatttggagacaaagactggaatcccctctatcacgtaccctcttccagattcagcctggagcccacactttccctagttctccatgatgctagcagcagcagatcatggtatttctgagccttggcagtctcatataaaatatgacccgtgggttctgtttctccaagggaacctaagacaagtctctacctggaagagaggttttccttttcctcatgaaccttagtatgttatcagaaaatgtgtgcgatgaatatattttataaaaggtagctctatgagtactgatctgaaatcacagctgtgtcattaaacttttaaacaatgacaactgtgttatatatcttatttctcaggcacatggggaaaatccatatatagacgctacatatagttttgaacatatccaggcacacagaaacgtgcacacaaaaatacttgtttgtaaatgttttctgagagcctccagatagctggatgaagggattagagtcatcaccagaccctgtgaaccttagtatcttgggccctgtacatgaactgcctgaaaaataaaaaaataaaaaaataaaaaaaacaacctctagtaagtttgaaaaagaataatttgctttagccaaggcactggtatcttgtagctgataaatgggatgtaagctggtgtagttgattgtttttactctttgttctttaggggcccgtcacccagctcccaaataaatacacatgtagtttttattattacttataagtgcttgactttagcttggcttgtttctagccaacttttcttaaattatcccatcttacttttctctattctatttactttgctttacctcttactctgagactggctgtgtagctaggttgctagcccctggtgtcctgtttttacttctcctccatctctcctcccagagttttccttctatttattctctctgcctgccagccctgcctatcctttctcctgccttgccattggtcattcagctctttattagaccaatcagatgttttaggcaggcaaagtaacacagcttcacagagttaaacaaatgcaacatgaaagaatggaacacaagccgggcagtggtggtgcatgcctttaatcccagcactccggaggcaggggcaggtggatctctgtgagtttgagacccgcctagtcggcaagagctagttccaggacagcctccaaagccacagagaaaccctgtcttaaaaaaaacaaacaaggggctggagagatggctcagaagttgggagagcgctgattgctcttccagaggtcctgagttcaattcccagcaaccacatggtggctcacaaccacctgcgatgagatctggtgccctcttctggtgtgcaggcatgcatgggggcagaatgttgtatacatagtaaataaataaatcttaaaaaaaaaagactggaacacatctttgcatcattaaacaaatgttccacagcataaacaaatgtaacacatcttaaaatgataatccacaacaggctgggtcttaggcagcacaatctaggagaaaagggcacactgggattttgaaactgaaaggaaacctgagtttcctactccatttgtttttgtttagaaatcattcactttcaggtctagagagatggctcaggggttgagaacattggctactcttctggaggacctgggttctagtgccagtacccacatggcagcttgaaaccaactgtgaccctagttccagggaagccaaagcccttttctggcctcctcagtcactgcacacaagtgggacacatacaggcaagacaactatacaaataaagttttaaaaataattttaaaaaattttaagatcattcatcttcaaggccactcagctgagcaatatagtactttcccattagctttactataagcaacacctctagccaggtgtggtggtgcacatctttggcctcccgcatatatgtgacatttgtgtagcttggtcttcttgtggaactcctaacagtgggagcaggggctgtctctcattcagttacctgctttggggactctttcctctgactgggttccctcatctggtcttaataggagaggaagtgcctagtcttactgaaacttgatatgccatggttggttgacatccatgggaggcctgtccttttctgaagagaaatggaggaggaatggatgtggggttgggagaaagacggagtgtgggggaagagactaggaggagaggagggagaggaaactgcagttgggacataagaacaataaatattatctctgtcatgttttatgttctttttatctgctgttttgtttatatttatacttgtctatgaagaaaggctatgattggcaataaaaattaattaattcagctaaatttttaaaaaaccctctgaagtgttgatcatgatgctaacagttgcctagttatgtatgaaggccattttgctgaaaccatcaactcttcacttggatctatacagatgtcatcttttgatatcagaaagccaaaatacaaccctcaaaaatgtggaatacacctttttgtatattgtgaagatgtgtcactctgattggcttaataaagagctgaacggccaatagctaagcaggatttctgtgcagagaggatgctgggaagaagaaactggagatgccaggagacccagagcaagcagaataggcaaaagggaaatgaggtaataaagccacaaggcagaaagtagattaagagaaatgggttaacttagaagaactagtcagaaacaagcctaagctaaggttgaattttcataattaataagtctctgccatgtcattactggggagccgtgggtcccgaggaaaaagtctgactgcactcaaatcacactaatgcagccattttgtggacatgtgtcttatgaaaagacatgatctaggcatgagccacatttcatgccagtattcaggaagctgaggaagttggatcttcatgagttcaaggccagcctggtctagagggcaagttccagtctaactagggctacatagtaaggccctctatggaaggaaaaaaccctgctggtcactctagccagggaagcagaagcaggtagactaactgcagatcttcacctctccctcctctcctccaaacccaaccccccagtctcacctcagctctgtagtagactaagacactgtggcctctcctcactctctgtccccattctcagaagactcagtagatcctggtgaaacactgcttttttttcctcctgtgatcttcctcagccaccaccacccctttcgagcccatctgagtcttaagagctccaaatacctagaaacccattctacctggaaccccctgtggccacacctaacagaatctgaagaattccttaccaggcaacacacagccaccacactctaagaaccagacggcaacagaggacaaggaacaaaacacccacccaccaaaaaacagaccatatattagcacctagaattacaatcttctcaaacctagatgtctagatgctaccgtaaaaatacaatcaataacagccaatataatatgtctccactggagcacagaaaccctaccacagcgggccctgggaaatgcagcagagctgaagcaacgacagagacattaacacagccctcatgaataacatagaggtccctccctccctctcattttgttgtacccctcttccaagtcagggtttctctgtataacagccctggctgtcctggaattcaccctgtagaccagtctggcctcaaactcatggagatccacttgcctctgccttcccacccccagcgctgagattaaaggcatgtgccacccttttcgtatatgttataaatgagcaaatgagcaggtctctgcatctgtatctgtttcttgtgccttttcttgtgctcttttccttctgttttgtccaattccaatgtatttttttcttttctcctattatagtttatctcttttatccctgttttctaatgagatatggatgggaggacagtgggaaggagctggaaggaattgagaattgagggaggggaaaaacaatcaggatcactatatgaaaaaaaaactcaattttcagtaaaagaggggagcatgggggttcattgtgcatgtgccaaccactgattacacctgtgcccaatctaacttttcctatgccacagacaagcctgttcttttcttttcttctctctctctctctctctctctctctctctctctnnnnnnnnnnnnnnnnnnnnnnnnnnnntatgtcatctagtaaagaaacaaagtggtgagagcatttaggttgtcttcaacataagaaacctcaagtgaacagaggcttcctaatgttctaatgtaataaccagtgttgccacaaccccaggacctcagggcatcagcttgtagtgaataaacagaatgctcatgtgtacacttgagctaccatgtagacagctggagaaacattagctctaagcatatcgggcaggacaattccagaagaaactagaatttgaatctgtaaggaagaactcagccatggagataggtgtcatccagttggctcaaggctaggaaagaagagggacagaaaaatgaattccccctccccatccctgtcagctgaaacactcttctcttgcccttggatgtcagaaaggggccttcaatctcagaatgaaaattattctgttgactttggacttggttccaagtccttttgacttggaccgagccccactaccaagtgtgtccccattatctggcttgctagacaagcctatgtcagacatagcctccatgattgcatgagccaatctcatgatagctatcatcaatcatttttgtgtgaacctcaccatgctttctttcttaattattctggaccatctggcagccttcaatgccaactaccctagctgctctctcttgctgtgataaaatactgtccaaaactgatttgggcaggaaagagtctatttggtgtacaggttacaagcctactatttatggaaataagagaccatggaggaacactgacttgttctcaaactcaagttcaactaccaatcttatataccctaggctcaactgcctactaatggcactgcccacagtgggctggaccttcctacattagtaatcaagaaaattcgacacagataaacccacaggccagacaattctcagttgagattctctcttcctccgtgtgtcaagctgaaaacagaagctaattatgacaccagctggaaacatttcagtctatcccacatcttgactgttcaccacatcactcaacatcatctgatacacaattacgttaccaaacttttccctcaactacgatgttagctaaaatagaccattgtccattttgttcattttgataactgctggatctcaatgtctcaaattgtggggaaccaaaatatttccgctatggaatatttttgagatccagcctttggtctcactaaacatggagcaccattattgtattgttaatgccagtaaggctactattgttcacatggcctcagggtaatatgcctcctaatttgcatctctatgctcctaagcatctgaataggccctcacctgggcggaggtgctagaggtgtgtgagtaacttgtgaggatggaaggttaggagtgagggaacaaagagagaaatggttccctcgtggtattgacaggatggttaagataaaccagaaaagatggctaataaagaaatgactctagttctacaacgtggaactgaaagctctctaaagatgacaagatgcctgtgtttgatctttatcgccgttgggtggctaggagcttccagatccacactcccactcaggtagaacctcatggttgtcgtgggttaaagatgagacatgccgggtcacgacatcaaatcaagaagtcttcagtcattcaatattaaaatccactcagtcaataagtaagaaaaatatatttattgagagttccaaaagaacttcatggaggaggaagaagtacaggcaagataccggggagggaaagccagcaggaatgaagacaggttttctggctagtgaggtagggcagtcgttggctttattttttcctcatataagatgcattctggaaactgctttctctgttgaagaccacaacatagcattcccagcctcccacatctccctagagaagtggctctcaaccttcctcatgttgcaaccctttaatacagttcctcatgttgtatgaccccaagcataaaattattttattactaatccataactgtaattttgctactgttccgaatggtaatgtaaatatttttggagatagagatttgccaaagggtgtgcggcccacaggttgagaaccagatttttttttgacttagaagaacaatttcactataaatctggacttgtagacagcctgagtaaggtataccacccctggtccaggcaactgtggccaaaggaatagataacatcatctgccagcaaatggttttcagtttctcagggatactttgttcaaaggcaaaactatccatggtcagacgtggttagaaatggtcaaacttttcttaaatttttaacttggaagtatgccactgagaaaatgactccaatcacattcaagggagtctttaattaatgtttggtagaattcatttgagttcaatcagtggagttcctaaccatcccatttgacatcaattccttaagcaatttaatagcacaggcatttgagaaatttgactagaaacagacagaccttcccatatgtttaagtttgagttaacataataaattaaacataaatgactaagttccagcaacatttcattatttttgcatccatggtaaaatatcaaatattttccaactaagaagaacaagtctaagaattcattaagcatttgactcctaaggccaacattacatattgaaatatgtcaattatgttaaaacacttcacataaaaagttaatagtttcaatgaatacaaaaacaacttctgagttgggtgtggtggcacacacctttaatcccagcactctggaggctgagacatggatctctgtgagtctgaggctagcctggtctacatagtgagttccaggacagccagggccacacagagaaatcctgtctcaaaaaacaaaacaaagaaaaactccttaacataattgcatggaggactgtgagaaagtctcctaatcctttcaagggtctgtaattactataaattttacacaggagctgcaacactcttagtttgtcaaagggagtgagtagttagggtccagcaggcgagagcaatgcagggatgataaggaactcaagcctggggaattgagcaactttaatttaacgttagttacaagagaatgactgacactcactcgggtaggtgtgagaagtaaatgaagtaatggccaggaaatgctccagagttgctcgggggacagcagcaacagctttaagatcacaattgcccgaacaaactctgcatacttaggaagatttacttcaatagctgtatttaactaagtcaaccttctcaaccttaaagcacaggctctcatttgtgactaatgttgtaactactcaaaaaaagcaagctccagggttctcacaagacacagtatcatatcacagaactgtttcagctcactaaagagaactatactctatcgttgagcttgtgtccacaccagaacattctagacatatccctactcttctgctttaaggaaatctaaattcacaaaactgaatcattacaaaatctttccccaaggactcctttagctcaggatgccgtctccagatacattgctaacctaaggacggtacctgaaggaaggtagggcagtaaaggctgtggatcagtatgttgctcacaagtcactgactgtcatcaggaattgagacacctcagaaagccaagaagacgaaaagaatctctttataaaaaatatagtttacaatgaactttcaaaaacacaatttttcaaagcaaactgctcctgtttgaggttcagacccacacaatgaagaacagagaaaaagaagcggaagtacaggaaagagaactgttatctgctccgaacacacacacaggctaaaaggccattgccgtaagggaaaggacagcccttctcacagacctgaggaaggtgaggatggaaggaaggcagcagaccatgaggaggggatctggttcagtcaggtctctctggactttgtcctgcaaagaagcagagacaggcaagactaaagaaaacaccggtggagagtagtttgtaggtaaaagactcatcacaccctaaatacgattctaggagcaccagtcagtgatctgccacacttggaagacagtcccacaaacagctggtgagaatgtgtgaccaggacttcgaagacaccagtaaggagtgaaagttctcaggggcactgagtacaaagaaagaagttttgcgttgctgctgttcttggtatttcccaggctagaagtagaaaacaaaagaaaaaccaaggttctgttcacttggcagggctccacttgggaccctctccagctggccacataaggccccacagcaactgagggtttggctacattaaaatcagtatcaactcatccaaggtcgacagacactgtgcccgagacaactaagttcttctagtggaagacatcaaaagataaatcaaattaatacatggaaaaccatgtcttgaaacaggtacttatttcccaattataattaatccagtctcttccataaaactcctgtaaattatcttattgaatgtcttgaagatgcttccttctcagtaattaagagttaggagttcttgtctgtgtcaccgggttgacatggtgattctgtcttctctgggagttcagcaggcacattctctgacagagagacactgtcatttcttgacatggtggcgaacagcatgtccatcatccccaaggtttccaggagttccctttggtaatcaatttctttttctacgagtccttgaagtactataaactttttatcaactactggtgactggccaatcacagggagatatatatctacaaagggcagaaaatacattaactagaaacattttctgtaggtgaaattgatacaaacagtatggcactaaaatataaaggcactgaataccagtatttttaataattaatttgttatttacaggaagcataacaatctatctgactaaatacattttgaaaagaaataattacacaatatatacagcatggggtcttattttcattttcatgttaaaaactagatgactgggggctgaggagatggctatgggtaggagtgcttgctttgcaagcagttaagatctgtatttgattcccagaacccattaaaaaaaaaaaaagaaagaaaagaaaaagaaactggccacctggcatacaactgcaatgcagccctggggaggtagagacaggtagcccagggcttgctaggcaccagctgagctctatgaacttcattcaggttcaatgagacagcctgcctcagaaaaacagatggagagtgatggggaaagacccaggaagctgccctgtggcaaacatgaaacaatgtgtcaggtacggggctgcaggaagagatgtagcacaggaaaggcatgggggtgcaacagtaagtctcaggcaggaccaagtgagatccagaaacactgaactttagatgcataaatgaaacaaaggaccctaacataaggactcagaagtagacagggtgaatccccctcactgtggcttcaggaagagagaaaaggaccactttggttggttgccgttacactaccgggctctctaaaaatctagaaaaagagctgagactcacgcagcaaacatgactcagtttgttcatgcttgtcacggtgaggaatcaccttatgttactaatctcttgtggaggggggatggggggacaacaaacaacacaacacagggggacacgggtgacagggacacatatatgacaaaggatcctctgtattttcttatttccaagccccaaaggcctctctactctactggataagaaagtgtgcatcacaaaagtccatgtggacttgggaaatggttgtgacttggacactacatcagatataaggattaaatgatagaaagctagaagcaccctctactttttactgcagttgagaactgccaagtggaagaacaaaagaccaactgcatgggaattcaagggaggaaggggtgtggcagagactggcctggccagagcacttaggatcactcagtggtagcttagttgccctcagcgtggatcccgttgggcctaactgctttctacattctaagccccagagacttttaagagaaatgcaaccactacttggtgtttcccacgcccccaccgggactggtagaatacctccataataaagcagcaccctgcctggtggccctctggctcatgagagcagcctgagggtggatgctacatgaccctcactactgaggttgcacacagacatgcaggactcaggccagcaaccctccatctcctcagcaggaagtaatacactgtccccgcccccactgttttgtattacacttgctcaagttctccttctcacactttcatcctaaatacttctttctcctatcttgcctcttctctttcctttcactaatctccattgttatttataatatttttaccttcactgagttttaaattcctagctaaccctatcactccctcgggtgggccttactcttccttcttactggggtatagctgttctcaggtggtttgctatatgtaaatatgggtttggctcagccatttactgcagcctgctttctttcctgtgtgtagcagacatagatatcaagcaaaggtctccatacagactcagcagagatatccatcccaagggatgtggaaatcacaatggagaatgggagaaaagcagagcagcaggactcttccacaggacgctaactcttcaactgctggacctgcagacaccgatggagctgaaatacctaacaaacacaatgacctcaaagacgcaaccatgaaatagatgaaggaagtaaaaagtcagaccaaatgcaaaccttggatatgaatttggattaagtcaagcaggagaaggtgggagctcttaggctgaggaattatcacatccattaatacttgtcaacaaccaaagcaaatacactcacagatttcaaggactctagggcacgacaaaggaaaaacaaaaaatctaagtatcttcaatgtagaagcatacaaaatctaggcaatgaaactggagcagaaaatttcaaaatccagggaaagatacagacatccaaatacaggaggcactcaaaacctaaacacatatgtccagaaaagaaccctcctacattgtccaatacctagcatggaacaaaacaccaagttactcacacagatgagttcatcactaggacactaggcctgtcagcaaagcaagggaaataggaagtgacgtcaagccctaagaggaataaccaccaaccaagagaattccatccactgaagtcttcctttaaaactgatggagggaatagattgaagccatgaccactaaaccagtgtaaggacagcgacacggaaggaaagtcaacacacaggtaagaaagtcacaatcacacaggaaattgagaaaataagtaataagagaaaatagatgagtaaaagaaaattaggaaagaatcagatgtttccaattcaataaaccagcaaatctctaagatgaatagacaaggaagaaaagaacagatcaactgggggaaacaaggatcttataggaattagcacacacctctcaattctaaccccaaatataaacggcctcacttcttcaattaagcatgcagacatggctgtgcatagcgacacatgcctataatgccagcagggggcctgtgctcacacacattcatataaaccatataagcatgaagaaatacacacacacaataaataaataaattaattaaaaaaaagaaagatgaccattatagatgtttatggggaaaactttcttaaattatacttatcctagtctcgtcaattcaaatctgctactgtaacattttactacattttaattgcacctgttcctctaggtttcctgtttcaggttctttcactgtttttcaatgctgaggcgcaagtgcaggagccgggacaggctgacacattctgccgctgagctctccagtccaaggcctcagctctcacagcatgttggaaagcttatgttttacgacttaccaattactatttcagcagcattaatcagaacaggggcaaatctcggctgagacagattcctacaaagcaaaacttctgtttaataatcttgcaaggcctatccctggcacttaagctggcatttgggaatctattccccatgctgagttgcctcgcccagccttgatgcagcgggaggagctgtgtcctgcctcaacttgatgagccatgctttgttgatgcccatgggaggcctgcccctttctgaatggagatggaggaggagtgaagggggaggataaagggagaaggcatgggaggaaaggaagggggaaaaactgtggttgggatataaaatatataaaaagtttaattaataacttaaaaaataaataaataaaatccctaaaacaaacattgttacaccagttctctgtaaagagcaaactaaaagtagatgtctctcaccgagtgataatggaggacttaagccacaaagccaagtcaagcataccttatcaaaaagttcagaacccgggtaatctccttctcatcccgacctgcaagagcattggctaggactcctctccgattcaattcctttatgatggaaactgtaacctcgggcgtctttattacacaattaggctagaaaaatgttcagagtcagtacagccaaaaggacggacaagaaaaagatcactaccctgcactaaactgccaagcttatctccacaatcccaagtcatagtaaatcataaaccatcatcaagatggttccccacatgtcctttcactttttttggacagggtctcactttacaagccttagcaggccaactttattatatagcccaggttgaccttactccagagactatttttgtttttttcttttttgggggggggaggtgtggggggacagggtttctctgtgtagccctggctgtcctggaactcactctgtagaccaggctggccttgaactcacagagatccgcctgcctctgcctcccaagtgctaggattaaagatatgtgctaccgggctggagagaaggctcagaggttaagagcattgactgctcttccagaggtcctgagttcaattcccagcaaccacatggtggctcacaaccatccgttatgagatctgatgccctcttctggtgtgcagacatacatggaagcagaatgttgtatacaaaatgaataaataaaatctttaaaaaaaaaaaaaaaaaaggatatgtgctaccactaccaggttagaataattcttcaaatactcttcactagctaagcatggcagctctcaatgctgggaggcaaaaacaagaggatcctggcagctcactggcaacctggtgagctccccgtcttagacagtttatcacctgacacaagcaagagtcacttgtgaagagagaacatcagttgaaaaatgtctccattgtactggcctgtggacaagtctatgtggtattcactgtggtggtgccactcctggcaggtggtctgggttgtacaagaaaaacaggctgagcaaaccatggggagcaaaccagtaagcagtgttcctttatggtttctaattcagttcctgcttccagatttctgccttgggatcctgacctgacttccaatttcatggtattataaactgtaagatgaaacgcctttcctctccaagttgctttggtcatggtctttacattgcaacaaaaagcaaactaagacagatatgatctcaagaagatggaatgatctctggccttcccatatgcatgtaaatgtaccctatcacacacaaaaaaattaaaaaatagtgtgaaaagacaattattctcactcacctcaaggactctgtcaagtgcctttgagatccgaaaacttttcaggtccttgtcataccattctaggtgtttctttgctggcctattgatcatgatatcatcctgaatgaaaaagtaaatttatagaagaagaaagttagtatctatatagttccattaaaaataaatgttttccagtagagctggccctggcgatatgagtaagggagacctggatgtgagggcccaagagcagaacttgctacagctccttgctgtaggctgcattgggtgagctagccaaggcagtgctaaagagctcatccaggttgtgaagatgagggaaagctagtgatctgaccaacccagccaccacccaggcccaagagttggcccaccccagccaccaaatctatgaactgttgaagcatgtgaaagggatgaacctacagttccaaaacagtatgacatgggataacaacaagatgtccaagaggagccccagtgagagcccattaacattagtgtagcataaaccagaggcctctgatcagaccaatgactcctggtaatgaatacttacaagtaaacatgaacagactaaagggtaaactgtgtgtctcaactggtcacactacagcttccatgacaggattctttttttgttttttctttgtttggtttttcttttaaatttggttttgttttgggggttgcaagggcagagagcaattcaaggggatggggagataagtggggtcaaaatgcatgatgtgaaatccataaataatcaacaaaagaaaaaataaatatttaagtaggtatgttttcacaataaagtgatacatgttaaagttaggatgcttttacaccacacaacaaataatgtttctatgttcataatccaagtgatacattttgccatgtcaatgtgctcttatgttttttagcttactcaaaaaaaaaaaaaaaaaaaaaaaaaaaaaaaaaagcagtatgaccacatataaaaagaagtaaaaaacaaaccagagactacaatgtaatcgtcacacctctgatgagctcctgggtcattagaactttacatctcagtcctctccaacaccagggagacattacaggcacacgctgttcagaggaccaaatcagagagtgggtgacagacactattttgaagacggtaaagcactgtattatttcatgattcagggtactaagtaagtagtccctgttccccattattcttcaataatgtactacagcagtctggaaccaactttgatggagtgagaagaaaataatgtacatgtatgtgaatcacactttgcagtaaattccaggaatgggtggaattgactcttccaagaaatatcatactttcaaaaggataagaaacacataatcacccgttgcttcatgtaaatttttcctttaacaaaggttcggtatgcaggcctcctccttcttgagagagattccttctttgcttcagatttccggtgtttaacgctcagtatcccattagtcattcccacaactatcgtctcatcttcatgctaatggtaatcagaaaaaccattctactttaaccaacatcttacagtacctttgacttgaaacagcatttgcatcacgtctgctatctatcttactgcccacagttcgagtcaatacagacagtgatctacccaaaatgttacagcaaattcacttttcctccagggtatcactatcgggacagcccttcttatgcttgtacagtactgccagtgaagtgtatgtaatgagaatgatgatgttggctgatcatgctaataagatgctaatggcatcttgacaagtttcaaaataattttctatgctctctgaatagaaaaaggattacacaatggcatgacttttgtaagctggctccccacaacagctgctcttgactcttcttctctaggttgaaatttccatataacatattcaggtatcttctggccaaatgtggctcctcatgaaacccgacagtgaacactccagaaagcacattgctcactcagctgctcctaccctctccacttttctggggccaatctgccattctcgagctttgtaacacccttgggcttgttgaagggagagttaacaacatcctaatccagttaccatgatagcagtcagtgccaccaagtgggaattcatgtggttaacaggaaacatcacatcctagcaactgtctttgttagtatttgtttagtatttagacatttgtactggcctgtccttggggttctgacaggatatgccctcagctgctgccactaagagcaacacctgtgcctattcactgtgttccctttcaaaagggccctgccctcctccatctctctctctctctctctctctctctctctctctctctctctctctctctgtgtgtgtgtgtgtgtgtgtataccctgtcttttctctctcctgctgttcctgtccctggaggctagtctctcttcttcccttcccccttacgattcttttcccctaataaaaaacctctccacttgaactctgttgcatatctttctcagccactttttaaaaattacaacagtcttgactcaaacatcgaatgtaccttatttgaatccaaagataacccccaaagattacactttacttttacataatggcataatgtgtaacaacttgagaagaactgaaagtacatacagacagtgccagactcaagatggaagctgcatagtcaaaactgtggactactttgtaagaagttgtgctgtagaccttgactttcctggtgagaaagagagccatcaagtcaccttagaatgagtgaaaataacaagtttctgtttttagcacactatatgaatatgaaaatttacacagtctaaccgggtgcttgcctttaatcccagcactcgggaggtagaggcagtcagatctctgtgaattctaggccaggctagtctacacaactagttccagggccgagggctaaacagagaaaccctgacttgaaaaataaataaataataaagtaaaatttgcacagtccagaaaaacactgatgtaatattaattacaaagtacttcaccactgagttccttgaaaactaactgtatttcagcactaaccaagtttgaataaagactgactaggaatttataaaagaaaccaaaagacagaccatacaccaaggtcatcagaagataaaacaaaggacctatgaaaatgcacagtaagccacaaggtagggtttccaagcccaataaggccctctgttggggacagtagcagcatctctggccatgtcttttcctaatagcagggaagaagtacaacctggagacaaaatgaccatcagaaaaaaaaaggaaatcctacagcctgtcagtactacccatgtgtgactactgaacccttgacatgtagctacagaaaaggaggtaagtttaaaaaccattgaaacatttataaagtattatagcataccatctattttagagacaaaattcatttctagcatctttctaagtaaactgattacatgttgaaatgacagttcatacgagttttacttttatgttagataatgaactacagtgaaataaatatgttactaaaagcaattttttgttttgctttgtttttctagacagggtttctctgtgtaatagtcctgggtgcctagaactctctttgtagaccaggctggccttgaactcacagagatccacctgcctctgactcccaagtgctgggattaatcacacctagcttttttttttttttaacatcttttaatatggctactaaagcatttaaaattacatatgcaacctgcattgtgagtttgtttgacaacacttttaaatcatcgaaagtagaatacttcaattgactatttaaatgacttcagtgctggggatagaatggccttgcaaatactgggtaagtgctctagccactgaactatgcctttagtgctctagaaatttacttaaagtcatagtacttgcaccacattaatgcacagaaatattcatatgaagtttgaaatcttgtttgttgtttttgaggcagagtctctctgtagccctagctgtcctggaactcactatgtagaccaagctggccttgaacttagagacccacctgcctttgcctcccaaatgctaggattaaaggcatgggctactactcccggttgaagttttatattttaaagaatttaacctaaaataaaatatatcctcagaataaaattttcaaaatacatatgtatatataaaatggctttaaaagaaactatgggaaaatagactatttcaaaagatcagtgttcaagtatgtaagttaaagtaataaataattatttctggggaaatataagtagttatatgaaaattaaaggtcaaactattttcaagtcaatagatttatcctctataaaaaccattagaacctttttaaatcacaaatactgctaaaataactcaatttctcaagcagtaaatgctaataacaacgcacaagaaaactagaatgctacctatccagtgagccggagagtaatctctgtccagagctgctcagacacaagcatgtcacagtcttatgatgatttttcaaagacacaagcaactgtcctccttttaacatgtcccagactttaacataacgacctcctgtggaaagaaataaccacttgtgtgagattctgcatatgctcagaatgctggagatctgagaagcactcctcactggagctaagtgaagcctccagaactagacctgagcttaaagaagcctccagagccagaccctacctgctggccacacacaccttgagagtccctaccaacagaaatgttaacatgactaagttattgcttattttaggtacagcaaaacaaatagggagctgaaaatatttcaagtaaagtataataaatttgctgagagaaatactgggtctgcaagatggctcagtaggtaaagacacttcccagcaagcctgaagacctgagtctgatccctggggatgacccggtagaagataggtggctccggaaagttgtcttagctggaataacagaaggttatagagtagacttctgaggtcagatgggacacatacataatctactaagttctcacggtctgggactttagacctgccactcaccatgttgccttggacaaactagctgatgctttcattatttccttaattgtaaaacagaatgccaactacctgggagaactgtctagcattagaaatgacatgaaaacagcagcacagtgccagtgtgggccagacacagtgagtgacaactactagcccaccccacttaccaactgaacaaatacttagatgtgaaattcaagaacaccaacaatctacaaatggcaaaaggaaaatctaatctctctgagaccaatagtggcaaaagctcttttgaaaagcaatacctgaagacaccaggagacctcccgaggggaaaagcaggacactctccacaggctgcccatgctccacacagagaacattcttatttgtccgggcgtcaaacatcttcacagtgtgatcatatgatcctgaaatgtcaatgttggtattatgtgaattttgctctttaaagcaataaaaaatttgtttatccatacattaaaattagaaggagaaaaagattacatgaaattttttgaacatacacacatgattcataaagtcggtacttctgatactactgttcctaaagcactatgtaatactacatagaatcttactggctctgaccttcagactcctatctccatgtcattccctgagaatctgttcagacacctacacaaactgagctccacctacagtgctatggctgctggggctctatgacaactagagtaccatgagccactgaaacctgatatctatgatactgtcaagcagctaaatatattcccctccccccaaatacatttagaagaaacaaaacccactatcaagagaagaaaaagaaatcaaaaaataattgactttaatgaagaccacacacatacacattttatggtgctgagaattgaacccagggtctcaaacaaattaggcaagtgctccaccactgaccctcatctctagtaatgaaaatgtaagcccctccaccccaaaagaacccatagcaataaagtggagagagcccaccaacctgttacaaagagatcagggttcagcttgctggcacagccacacctcacataatcggaatgttctctgaatgtctgaatttctttggagtttggaatatcccataatttaactgtataatcatcagctccggagaccacatgatacttgtcagctgtaaaatctactgtatgaactgctctgaaagatcaaaagtcaacagattacaaaaatggggaaaactcatgcttgatgatagctctcatccagcagctggtgcaagtagaagcagacacccacagctaatcactgaactgaactggaatccagatgcagagaaggacgagtgatgagcaaagggatcaaggccaggctggggaaacccacagaaatagctgacctgaacatcagagaactcttgctccccagactgatagctgagataccagcatgggactgatccagaccccaggaacatgggtttcagtcaggaaacctcggaaatctacaggacttgctgtaggtcagtatttatccctggcataggtgtggactttgggagcccattccacatagaggaatactctctgagccaacacacacggggtgggcctaggtcctaacccaaaggatatgatagactctgaagacccccccccatggaaggcctcaccatccagggggagcagaaaggatatgtgataggtagggttttagttgtggggtggtggtagggaaggatgggagggagaagggaactgggcctgtcaagtaaaacaaccttgtttctaattcaaataataaaaaaaaactgcaagaaaaaaagataaaaaaaaaaaaaggggaaaactctaccgccttcatcttctaacataaaatgttccttcctagattcaaaaacaaacaaacaaacaaacaaaagccccctcaggttcaagccagcaagacagctcactgggtaaaggtgcttgctgccaagcctgatggccggagttccatctgggaccccccatgatgaatggagagaaccaactccggagtgttgccctctgacctccacatgcatgccaccagatatgcacacctgaacacacacagtaagtaaacaattctcaacttcagaaaatagaaaacatttatggaagaaaaaatagaaaagggaaaacctttaaaacaggtgtttgtatgtaaatgtaatactatgtaccgaagtgtaatactatgttactattaggtcaacaagaatattaagtaacagatgcaataattagtgaaagttaagttctaaatgttgcaacagaggtaatttttaagtgtttatttatttatttacttattttatgtgtatagtattttatctacatgtgtgtctgtgcactctatgcatgcctaggactgggcttatagacagtcctgagccagcatgtgggtgctgggatcccaacctcttccagaacagcaagtgctcttagccactaagccatctctccggctctgcaaaggtacatttctttaaaaacataacaaagagttctttcaaaagatgagaaagacttgccacagagcagaatcccgttaaaagaatttgttttgagtgttttagtgatgggtacaaacaccctgacagtttgcaatttaaaaaaagaaaaaaagaaacactttgatatttaaatcaacagcagagttcagcaatgactttagtgatcctgaaacagaagtcagaaaaccaaatttatcaaagaaaagaaaggtagccagatttcagtgtgagagggtacagccagccggacctacagcatcaccagagctgtaagactgccgttagaccagtggttcacattttcaactggtcagagagcccactgaacctcctaaataattagacacatacaactttagagcagtcacaagctctaggaactggatggttaagttctttgtctgagaacaacaggaaataactatacatacaggtatactcttcacacaaccaacatgtgtttatcaaaagcatggaagcagagctctcaacagaaaaacaaattaaaaaccatatcaagctggctcttactttgtatggccttcaaactgcctgaggggagccctcccacttatatcaaaaagttgaaccacaccatcttcactgccagcaacaagcagttggccatcctgtcgaaaagtagcacagtatgctgtgtccttaaaacgggaaaaggtttttataggttcttgagagtatcggccataaatgtggatctgtaagataaaaagcagtatttcactagatggcccaagcccagtagtaaatcctataacaagaacaaagatgatcactactgtacttactcttgaagaagctgtgactgcatagttatacggaggctgaggagaaaagtctactttggacacggcaccaaactccttaatctgaacaggagtcttaatgaaaaacaaaagagtattggcagagttaaaaaggcgagccatacttaagcatcacgctattttctatggatcatttccttttgatcttagtaccaattagtaggttgtattcacagagaaatatgaggaaaagaggaagaggaaagacataagaaagggtgaagcaaaaaccactctattgtccaacccccagactattcccttgacattacagaagtaaacacagttagagagtcacatcccattgtctcagcagctaactttactccaatgcccaccaagaaaaagaagagctaagcctacatcaatcaactatgattctaagttaataaaaagatgaacagaccatgtaaacagacctacatcttttttgcacccactaacccattttagcaatctctgcatataagcaataaatttgccatccatttttataaagatacaccatccaccaacccatgtctaatggacatattttccaagaattccaatattacattacatatgttaataaacattttacatatcttaataaacgtttgaaagcatgctaggcttcaagctatgagtacaaagcaaaaatgatgtttttataaaatcctaacagttattgtcaattccctttctcaattttctttctcatttatgccaatatgacagaaaaaaaaagtatctaaactgttatcttatttggttttatgttctgtttttttcatcttatttatttgtactcatgtgtatgtgtgtatctgcttgcctaaaaatgcacatgtgtgaaacacatgctgaaggtagaaaaagatactagagcccctggaactggagttcaaggctgcccactgtgctgggaactaaacccaggtcctatgaaagagcagcaaatgctcttgatttcaagtagctaagactaccctcagcctccctgagtaacaaagaatgactctgaacttaccatctggcctccacctctcaagggctgagattacaggcatgtgccaccaaagaggtttgtgcaaggctggagactgaactcagggcttcgggcatgccagacaagcattctaccaactgagcgactccattttagtttgtgagtaacatttttattatctgattatatttcattttccacaaacaacctaattgcaaacgttttctagttttctaggttctcaatttaaaaaaaaaaaaattgcaagccttactagaaggtacagagaagctaatttcagagtaagaaaaagcaagaaagtcttcctgcatataagattcaagttttacagtttcacttgtcattgcacacatgttctgcattaaacatctgcatggttaaattaagtggtatggacttttacatgaagctctaagaaaaaactgataacaaattatccacctgaactattagttttagctaacagttctgctagcataagatggagaattaagataaatggataaagaaatgtccaaattctttcttccctcatttcctcttgtactttaccttataattgttccagtacagagtgtcttgggtgattttttcaccaagtacaggatatgtctgaatcgctacaggtttataaccagccatgatttcatatagttacactgctgtcccagggtcaataatctggaactgatgtcagggaactgcagtgactctgccttatacctaaaaaataaaaaagaaaagaaaagaaaaaagcacatattatgtatacactttcacatacaagtatgattttcattctactttctttcaaaaggctgtgtggaacttcaccgattagtgaccaacaaaccatttcattggaaccctagaagaaacactggaagaatacagcatctgcagcatctgtacatactagctgtatatgtatgttctcaaatctccaagaccagtctgtaacacttgaaaataaacatgactcagcctcccaacagtccaactagaaaagcatgcaggcctagaatgcttgttttcttgacaaaggaaataacatagaactcaaaatatcaagttatctctacatatttggcttcctaaagaaaaagataccaagaagaaaggaaaacaaagctaatattttagtgtagaagcttatgatgaaattagagataatgttctgacataagacaaaaggtttaaaaatttaactgtataatcatcagctccggagaccacatgatacttgtcagctgtaaaatctactgtatgaactgctctgaaagatcaaaagtcaacagattacaaaaatggggaaaactcatgcttgatgatagctctcatccagcagctggtgcaagtagaagcagacacccacagctaatcactgaactgaactggaatccagatgcagagaaggacgagtgatgagcaaagggatcaaggccaggctggggaaacccacagaaatagctgacctgaacatcagagaactcttgctccccagactgatagctgagataccagcatgggactgatccagaccccaggaacatgggtttcagtaaggaaacctcggaaatctacaggacctcctgtagttcagtatttatccctggcataggtgtggactttgggagcccattccacatagaggaatactctctgagccaacacacacggggtgggcctaggtcctaacccaaaggatatgatagactctgaagacccccccccatggaaggcctcaccatccagggggagcagaaaggatatgggannnnnnnnnngcagaaaggatatgtgataggtagggttttagttgtggggtggtggtagggaaggatgggagggagaagggaactgggcctgtcaagtaaaacaaccttgtttctaattcaaataataaaaaaaaactgcaagaaaaaaagataaaaaaaaaaaaaggggaaaactctaccgccttcatcttctaacataaaatgttccttcctagattcaaaaacaaacaaacaaacaaacaaaagccccctcaggttcaagccagcaagacagctcactgggtaaaggtgcttgctgccaagcctgatggccggagttccatctgggaccccccatgatgaatggagagaaccaactccggagtgttgccctctgacctccacatgcatgccaccagatatgcacacctgaacacacacagtaagtaaacaattctcaacttcagaaaatagaaaacatttatggaagaaaaaatagaaaagggaaaacctttaaaacaggtgtttgtatgtaaatgtaatactatgtaccgaagtgtaatactatgttactattaggtcaacaagaatattaagtaacagatgcaataattagtgaaagttaagttctaaatgttgcaacagaggtaatttttaagtgtttatttatttatttacttattttatgtgtatagtattttatctacatgtgtgtctgtgcactctatgcatgcctaggactgggcttatagacagtcctgagccagcatgtgggtgctgggatcccaacctcttccagaacagcaagtgctcttagccactaagccatctctccggctctgcaaaggtacatttctttaaaaacataacaaagagttctttcaaaagatgagaaagacttgccacagagcagaatcccgttaaaagaatttgttttgagtgttttagtgatgggtacaaacaccctgacagtttgcaatttaaaaaaagaaaaaaagaaacactttgatatttaaatcaacagcagagttcagcaatgactttagtgatcctgaaacagaagtcagaaaaccaaatttatcaaagaaaagaaaggtagccagatttcagtgtgagagggtacagccagccggacctacagcatcaccagagctgtaagactgccgttagaccagtggttcacattttcaactggtcagagagcccactgaacctcctaaataattagacacatacaactttagagcagtcacaagctctaggaactggatggttaagttctttgtctgagaacaacaggaaataactatacatacaggtatactcttcacacaaccaacatgtgtttatcaaaagcatggaagcagagctctcaacagaaaaacaaattaaaaaccatatcaagctggctcttactttgtatggccttcaaactgcctgaggggagccctcccacttatatcaaaaagttgaaccacaccatcttcactgccagcaacaagcagttggccatcctgtcgaaaagtagcacagtatgctgtgtccttaaaacgggaaaaggtttttataggttcttgagagtatcggccataaatgtggatctgtaagataaaaagcagtatttcactagatggcccaagcccagtagtaaatcctataacaagaacaaagatgatcactactgtacttactcttgaagaagctgtgactgcatagttatacggaggctgaggagaaaagtctactttggacacggcaccaaactccttaatctgaacaggagtcttaatgaaaaacaaaagagtattggcagagttaaaaaggcgagccatacttaagcatcacgctattttctatggatcatttccttttgatcttagtaccaattagtaggttgtattcacagagaaatatgaggaaaagaggaagaggaaagacataagaaagggtgaagcaaaaaccactctattgtccaacccccagactattcccttgacattacagaagtaaacacagttagagagtcacatcccattgtctcagcagctaactttactccaatgcccaccaagaaaaagaagagctaagcctacatcaatcaactatgattctaagttaataaaaagatgaacagaccatgtaaacagacctacatcttttttgcacccactaacccattttagcaatctctgcatataagcaataaatttgccatccatttttataaagatacaccatccaccaacccatgtctaatggacatattttccaagaattccaatattacattacatatgttaataaacattttacatatcttaataaacgtttgaaagcatgctaggcttcaagctatgagtacaaagcaaaaatgatgtttttataaaatcctaacagttattgtcaattccctttctcaattttctttctcatttatgccaatatgacagaaaaaaaaagtatctaaactgttatcttatttggttttatgttctgtttttttcatcttatttatttgtactcatgtgtatgtgtgtatctgcttgcctaaaaatgcacatgtgtgaaacacatgctgaaggtagaaaaagatactagagcccctggaactggagttcaaggctgcccactgtgctgggaactaaacccaggtcctatgaaagagcagcaaatgctcttgatttcaagtagctaagactaccctcagcctccctgagtaacaaagaatgactctgaacttaccatctggcctccacctctcaagggctgagattacaggcatgtgccaccaaagaggtttgtgcaaggctggagactgaactcagggcttcgggcatgccagacaagcattctaccaactgagcgactccattttagtttgtgagtaacatttttattatctgattatatttcattttccacaaacaacctaattgcaaacgttttctagttttctaggttctcaatttaaaaaaaaaaaaattgcaagccttactagaaggtacagagaagctaatttcagagtaagaaaaagcaagaaagtcttcctgcatataagattcaagttttacagtttcacttgtcattgcacacatgttctgcattaaacatctgcatggttaaattaagtggtatggacttttacatgaagctctaagaaaaaactgataacaaattatccacctgaactattagttttagctaacagttctgctagcataagatggagaattaagataaatggataaagaaatgtccaaattctttcttccctcatttcctcttgtactttaccttataattgttccagtacagagtgtcttgggtgattttttcaccaagtacaggatatgtctgaatcgctacaggtttataaccagccatgatttcatatagttacactgctgtcccagggtcaataatctggaactgatgtcagggaactgcagtgactctgccttatacctaaaaaataaaaaagaaaagaaaagaaaaaagcacatattatgtatacactttcacatacaagtatgattttcattctactttctttcaaaaggctgtgtggaacttcaccgattagtgaccaacaaaccatttcattggaaccctagaagaaacactggaagaatacagcatctgcagcatctgtacatactagctgtatatgtatgttctcaaatctccaagaccagtctgtaacacttgaaaataaacatgactcagcctcccaacagtccaactagaaaagcatgcaggcctagaatgcttgttttcttgacaaaggaaataacatagaactcaaaatatcaagttatctctacatatttggcttcctaaagaaaaagataccaagaagaaaggaaaacaaagctaatattttagtgtagaagcttatgatgaaattagagataatgttctgacataagacaaaaggtttaaactgtaggctagaaaaccaaaatagagcaaacttaaaatggcagaataagatttaaaaaatgtgggggagaaggaatgggggtgaggggagggagagggagaggggaattacatgtgaaacaagcctgttccctaacttgtattaataataataataataataataataataataataataataagagaaaaaaaagatttaaaaaatgaattaaagctcttaacatgcaatgaaaccaacatcttcggagaagcattcaactgaagacagtctattttatggatgaatggttccagtgatacaactctccatccatttgagagggctgcaaagatgacatcagtaacaccggaacaaatagcatgccatgttctgactaacgcaaagcaaaccaagattcaagagagaaacttttctattcagtcaaacacctccaatgtgcaagatagtattcaaggcactgggaatccaaggacaataaacagacatgatctataccttcaatgattgggcctattaggaatctagacttagcttcatcctcattcctaaaactctgaagaagtatcacgtatcactgccctctgatagagacactagcaatcaagatttcaactctcaaagatttctttgtgtgcaaaagtgtgtgtataaagccagagagtctttctctatagtgctgcaccttatttctgagacaggatgatatctctcattgaacataaaactcaccaactgacaacactgcctaattagcaagcctgactaacaagcctgggggaatcttcctgtccctgccacccagcactgggattttaggcatactccaagctctcctttttacctaggtgctcaggatttgaccccactatattcactaagacatctccccagcccttaatctctcaaatatttctaaacctcaaatttacttaaccctagttcaattgcactaacttttgtctttttgacaactgaaataaaagcaacaccattcaaaagtctcctggactcccgaatccatcttccaaatagtagtgtggctacaaaactgaatactgcccagaaaatgaagccctagatccttagcatgtaaggttccctttgctctgcccctttaagcttcacctcttgctgttactgtttacagttcactaaactcagcacactcattcattcttgcttcaacatgtgctctctaccaggaaggtcctttatctgtttaaggtcattgcaggaaatcagactgtccttcagaaatccctctctgccttctgagactgggtgctctctcctatgatccaatttgtctctatttctgtaagtgtgcataatctcgctgcattgtagtgacctttttccagttaaatagaacaacatattggaagtatttgtttgtaaaaatgctcaaacaatgatctttttaaaagggggagcatcatgaaaattcctattggaaaaacataaaatcaaaagcattagtggtttataataagaacaatgctatacagcaggtgttcaatcaagggccagccagatggtaaatgttttaggcttggccaaacaacaggcaaaataggagatattctataattaatgacataggaaaaattcacaatttttacaggaggcttccctaacaatcataaacacaatctttgttgttgtttgtgaaagagagtagaattctctgaggtcaagggctacttcacttaattccaagccaatcactgtacatataagacagtatgtttatctgttaaaaaaaaaaacttagctcattaaatatacaaaaacagacatcagaatagattcaaggatgggtagctcctaaatctatttttcaagaaataaaaccatttggaggaaagaagtgaatagtagctgtgacaaaatgaagataggcattggtgtcccgtatgagggaagacagtgcaaatagcgagttgctatgaaaacgaatgaaagaaaactggaccaaagtcagggcccaagaaactggggtttactgaataacaggcattactacaaggtgtgatcaaataaactctgtagttagagtactgagaacatgcaagaggaagatgtttaattctacctggaaaaggttttccatttcatcagcgtctgtgagcatgacatgacacgatgagcacaaaaggagtaaacgcagagtgagacgaatacccggccattctcaaatcaccaggacagaaatctgtccttggctttggagaaaagcaggttactctggggactgacatcggtggctaggagagcgactacagaggagcaaagcctgggtcgaattaaatcgcaaggatcctcagaggcaggtaagttcaatgatctgcggagcctgggaagggccagagcagcatgtccagcatgtcagagatcagagtgaggcctgagcagagcctgggccgccaccgggagccaccatcgcctacctctgcggggccccgagggtccgccgaggcaccccgatccccaggacgactccccagacttcgccagctcgctacagcaaatgtctcagaagcacttgctcaaactcacgcggacactccaggagccggaaatgcagaggcgccggagcgcggcgcggacggatgacgtaatggcgcatgtgcagaagcaaccaagaactacaagcgagccccggtgggtggagcagtcggggaggggctcggcctttctctggtgatccggaaccgaggtgacccttagttctctgagagcatgggctgcggaccgcgaggggaaccaggagaaatccctggaagtcgtctcgccttcgctgaatgctctgggcttttttcagaggaggaaaaatataggaagtgacgtctgggtccgaagcaggccgggcttgaggacttgtagcgatccgcagctggccctggccgggccggagcctcccctgcggtctgggttgtcgagtcacccgctggacggtcccctgtcccggggtccgctcgccgctcgagagcgagttcagcctgcggcgggaacgcccgccgggacacctgtcgcttgtgagacgtttttctttctttcttccttctttctttcctttctttcattctttctttcttcctttcttgtcttctctttttcttttttcttttttaaataacaactttttcgtctcgtaggacaatttcaagagtttggaagaacgggatgcctctgatatttgcttcccctgggtcggtgtccactgcccgcatttaagactctatctaaccttgcctgagctctggcaagtgagcctacctactgtctatgttaaccctttctgatcacctgttattcattcattttttttcctctcctgcacatcaccttttggcaaatgtacatctttgcttctccttggagcctacataagggttccttccatatttgctgatctcccttcaaagactggcaattccgtatattgaaaccttgacttgttctataggagctgcaaagaacattagagatgactatttctacatcattttataaacgattgagtctcgggaaatgtatacaatttgtgtgatcaacacaaattctattgttgagaatggaaaaccacatccaactaaaaaatgtgagaaacaaaatgttaaaaattgttgaaattaaggtcagaaaatatctatggagcaccagataggttttgtgtgttgtgactcccctgagtagttttagccaggtgtggtggcgcacgcctttaatccctttaatcccggcactcctgaggcagaggcaggtttcacacagtgtttccctaggccagccagctctacataatagtgagcttgactataaagtcagaccttgtctcaaaaaataaaaataaaaaagtggtctctatctgccagttttcccccttaatgggagtttgaaaggaagctgtcaagagaataccaagtgttaaaagaaacacatgacatccccccagggagccggagttgctctcagcccactgaccctagaaaaaaatggtacttcatgctgtgtctttttaaagacccagtcttctctccacgcctccatctttcattgagtctctgaactaactttctgttcttgttgccttctgacaaaatgtagcgactttgctatgggatactttttctgactatagtctgtcttcatctctccccggaagttttggactctttctattgctgtttacttactgaccacagtgatagagttggtagagcaaggtgtgtctaccgggaatcaggagctttttcttgagttgaaaaaaattacctgcctgttctactgagaagattgtaataaggatcaatatttttttgtgttttggttttttcgagacaaggtttttctgtattgctttggaggttgtcctagaactagaacttgctctgtagaccaggctggccttgaactcacaaagatctgcctgcctctgcctcccgagtgctgggattaaaggcttgagccaccaatgcccaacgggctcatatcaatcttttttttaaggattttttttttgggggggagggtaggttcaggacatggtttctctttgtatcccttggctgtcctagaactcaatctatagaccaggctggccttgaactcagagatccacctgcctctgcctcccttcactatctgacttattttgtctcttttaaggattttagggtctctcgattatgtagctctgactgtcctagaactttccatgtagaccaggctggcttcgaactcaagagattcacctacctctgcctcccaagtgctgagattaaaggtgtgtgtcatcacacctggcttgtgtaaggttttcgtatgtatgttttcagggctgttctacctattacataaccagtaggtattctcgtctctggggaagactgtttctcctgctgtatagtagtgcctccaccatgcccagcgggatcaatcttttgaaatgattttaaaattaaaacactgaacagtggttatgtggtcaattcatttttcccttgattccaagtcattctgatcattgcacacttagtaccctttcagaatgtccaaggtacagtatgctgtcacatgacaaaaattaattggatgttcatttcttcccattttaagggattatgtatttgggactgtcatatatcctgtgataccgatccataatctccatattttatttttcattaaaacttacatccagcccggcattggtggcacacgcctttaatcccagcactcgggaggcagaggcaggcagatctctgtgagttcagggccagcctggtctcagagtgagtgccaggataggctccaaagctacgtagagaaaccctgtctcgaaaaaacaaacaaaacaaaacaaaacaaaacaaaaaaccttacatccagccaggcagtggtggctcaagactttaatcccaacactcgggaggcagaggcaggtggatctattagagttaaaggccagcctggtctatagagcgagtgccaggacagcctccaaagccacagagaaactctgtctcgaaaaacaaaaaaaaaaaaaaaacaaccttacatccagttgtttatgcttactctgaacaaaagatgacagatatactttcgattcttcaacagtagattttgtaggtgcagagagatgactcaatgggtaaaggcacttgctgccaaagctgatgacttgagttcagtccctgagacattcatgaaggaagggagaaccacttcctgaaatgtgtcctctgacacatgatatgcctgctgtggcccatgtgttcccacacacatgcaaacaaaatgcaaagtaataactactttttaaaataagttttgcaaagtgcttcactgtctcaatcgtgtattatagagaatagtgctaatcaacttggctacaagttggttatatctcagttcaaactgggagcccacttacaggaacagcatttttaaaaaatgaatctcaaattatagcttactgttttaatatgagcctggtccttaaacatttgccaatagtcagatatcggaaagagtagaaactaactaaaatgtgttgaaacatagtgatggaggtgtactgtatttccttcatccttttccaggatgatggtggtatctctttttacaaatgatactcaaggtcattaactcatgcacatcacatagctaataaatgagaaagcttgagttcatgggcaggttacctacctctgagtattgtgtatctcctattatggacagaatcttacaagagcactgtttggatttgtggttgaaagtaattgtgtgtatacatttacataagttataatatgctgctttaaattttccaaatctttcctttcagatactttaatatcccaattccaagcatacactggaaaacacccttgcaaaaccaagaggaaaccgtgaagaaatgttttaattattgaaaccatggctacatcagcaaatctggacattggggcccagctgattgtggaagagtgtcccagcagctatagtctctctgacatgccagacatcaaaatagagcaccagctggacccaaactcagaagaagggtcagcgcagggtgttgccatgggaatgaaattcatattgccaaaccgatttgatatgaacgtatgttctcggtttgtgaagtccttaaatgaagaggatagtaaaaatattcaagatcaagttaactctgacctggaggtggcatctgtcttatttaaaggttgaaagttatggtataactccctacaattgctttcatttgccctatttcattctgttttcctctgccatgaaatcagagttgaggaaaagcatgaagttcttttaggaagatttttctaggatctcacagaagccaacattaaatttctattaattttgaaaaatattcctttctaagctggtgtagtgatgcatgcctttagttaatcccagcacttgataggcaaaggcaggtgagttgagagccagcctaatctgctctcactagttcagtccatccagggatacatagtgagaccctgtccaacaaataaaatccttgcctaatctttatttacaatttctttaatttggttattcttagttgtattttgttttgtttttgtttttttgagacagggtttctctgtgaacccctgggtgccttagaactagctctatagactaggctggcctcaaacagagatccacctgcctctgcctcccaaattcttcaattaaaggcttgcaccaccatcgcctggcctagttacatctttttaaataatagaaaaatattcctttttcaaaattagtttaatattttctatttcatgactaatttacatcttaatttacattttaatccagtgatctgtcagcatgctttaaagttactttgtaatctattaatattaaaactagtcaataaaatttttcaaaattaatagttttctttgtagaacttatactgtagtagtatagactcatacagaattactatcaactgatgaacacttgaattgaaactgttaagcctcatacatttttttcatgtgaacattgacacttttattagaatgctttgtccttaaaatactattttaatttgttttatttagctgagtgcaatatccatacatctccttctcctgggattcaagtaaggcatgtctacaccccctctacaacaaaacatttctcccccataaaacagtcaactactttaaccaacaagcacaggggaaatgaggtctctaccacacctctgttagcaaattgtaagtatgcgctaagaatgtactgaaacattactactagtgtaattaactaatgcaattacaaattaggaattgggctttgaaatattagtatccctaaataaacattccagtttggaaagcttaagtgatatatttatcactttaataaattgaaactttttcatgtgtttttatgtttcaccgtttcctgttatatctctctgagaacaaatacagtttaaaatattattaaaacctttatagttttaccataaaaaagtgagttactgtgaattatttgcaaattaagatatcaatgtttttgtgttcttgggagttttgtatttagtggatatgggcacatatttattgtaaatatgtccttatgtattatttcactaagaaatagtttgtactaaaagctaaataatttttactgaaatgtttcattagcatataaatataatgacttggaatgtaaagtcattatataggatataaagtttctctaagctaaccgatattgggtgaggcatgagtatttgaatgagagaaaacccagctaacagctagatgataataactacatttggtaccataatgtgagtgtgtctgtattctggtgagtatcttgatctttactttggaaatcttaaatccctccagatgtcacagttgcatactatagcagttgagccaggaagaatcttttagcattctaattccacctatgggccatttctagtttaggtaaatgtgtgtatgcttcacagttgcttttctgtattgagactacccagtcatatcactaaaggcagtattatttaaaggtgcttctcaaaaccattgtcttacaatattctaactgtagaacttctctactgaaaaaaataaaataaaaagctaaagactgtcccccctggcatgaataaaaaattataatcagttagtcagaattaacatgctaactagcctcaattaaacctctactcataaatttactttcaccaaccatggtggtcacacctataatcccaaaactcatgagactgaggtaggacaatcagaagtttaaagctatccaggctacataatgagactgtctttaaaattaaacttaccccctcaaaaaaaaaaaatctcacacagctagttttctacttatgaactcattcctaattttaagaaaacccatccaattccaaaataaaaatattcaggaggctgaagagatggctgagcagttaagagcactgactgctctttcaggggtcataggttagattgccaccacttacttggctgtcaacccccagtaactccagatgcctcaatgggcactgcaggccaaatacccacttgcataaatttaaaaatacatgtacctaattagcatttaaaaggctgggaatggtgatatatccctgtggtttcacctgtttagaaggttgaggtaggaggattgtttgagcctacatgctcagcttgggctcagcagcatggtgagaccctctctcgggaaaagaagttagctcttcagtggaatcactaagaaaactaaaaggaatgtctttttggccttcctcgtaagtttggatacagaagtagcatgttaaacattaagtacataaatcactctttaggataaattttgccccaaaaaatgataatttgcagatgtcatattaccatatgagtcagttctcagagaacactatctgaggataccaggatacttcccttcattaggcttacatgatgagttggtgggttttgttttggaaaagaaactggcttcaccctgagacaatagctgtgtacctacaagatgcacttgaagaattttaacattatattgtttcagctttgtctgttcaccagttggcagctcaaggagaaatgctctacctggctactcgtattgaacaaggtaatagcctagttttaagtactatattttaaatattcatttgaatttattaggtttgttatctgttttattttcatataggagactataaagacaaaataagttgtataatcttgccaagcacataagccaatggatagcaaaaagggaaattttaagtaacaaagtataaaatttgggactttagggtggctctgagattaagagcactagctcttcttccagaggtcccatgtttagttcccagcacccatatggcagctcactaccatctgtaacgccaggtgtagggtatttgatgccctctttctagcctccaagggtaccaggtacatatgtagtatacatatatacatacaaggcacaacaaccatacaaataaaatcacttgattttaaaaagaagttttagcttccttttccccaaaacaaacattgtaagttttttgtatttctagaaatcatttccatttatggttacatttgagaatatgtatgtgcttttgttaggtatacaagcaagaaaatgttacatatactgcaacatgtcttttttcatttaatattggaattgttctactaattggagagtgttctactaaactttttttttaatgtgtgtgtgtgttttgcctgtatgtgtatatgtaacacttgcatgcctgggacctgtgaggttaaaagaggatccctaagaactggagttaggatggtgccagccatcctgtgcgttctgggaacctgggtcctctgcaagaacattgaagtgctcttaactgccgagccatttctccagccataagatctttttcttgagaaagagtctcactatgttgcccaggttgacctcaatctcacagtcctccagtctccgccttctgagttctgggatcacaaacatgtatctctacacccagccattttatcctgttttactataatgtgtatgtattactatgatttttatttgttcttttaacaattcacctggctgattacaaatgtttgctggcaatcctagcataaattctttataaatatatacattgagtaaattttcatacatagtatgccaggtcataaactaaatgatttttgtcgtgccgtgggttgaatcagctcttcacatgggctagaacagtgctctgccccagagccacacctctgactctgcctccgccttcttgttgttacattttaactggatgtttgtcctcacattagccttagagttgcagtttccccaaactgtcacatatgaagtgagacttcagttcttaataatctttggggaaaagtggtgcctcacaggaattccactgatacatttaggttataatgcctttgagtttctttttgtctgaactacctacggtatatttgtatatttgtatcgtataaacttcaaagtggaagaaactgacttctgttgttttgtgcatatagttttccccaatttgtccattttgtatgacctcttcagatttttaattgtaaatttttcttctttttgactttggaagttcgtggcctactttgaagattccccactctaggattataaagaaaccactgatttttacgctggaacttgtctggtttccttttttatcatctttgatgtataagaaaactgccaggtggtggtggtggcagacacctttaatcccagcacttgggaggcagagaggcaggcggatctctgtgaattcaaggccagcttggtctccagagtgagtgccaggacagccatggctatgtagagaaaccccctgtctggaaaaaccatcattgttgattacagggagcatgatccaagaattttattttcataagacttagatgtatttctgtttatacttaactatcgggggctggagggatgattccaaacctaagagctggtactgtcttgcagaggacctcagttccatttccagcacccacatcaagtggtttacactgacctgtaactccagggagatctgaagctgctggttttcacaagcacctgtactcacatgcacccacaccccacccccacacttacatagttaaaaaataaaaataaatatttaaaagtagaaatttcatgttcaaaaaaatctgaaaaaaaatttcatgttcaacctactaaagtgtacagggaaagctgtgcagtttataactattaggctacattcagggaataaatgaggttaaaggtgaaataatgtgttacactaaagatgatcgaatctccatattatgctggcaactgtacggatgaaggaaaatcacaggcagcaaggctagctagagtggaaggtagctttcgaaagctgttgaagttttaagtatacatttaggtaatgctaagggctatcatgtatcattttattgtgatcttcccaggtatgtgttgagataagcaagctattaatctgtgtttagcagaaattaagtcacttgcccagaaccaaaccactagaaaatgaaagagccaggattctatcttgggtttcctgtccctgagaccaaagttgacaatcttgtacctaacacgatactatactgtgtgtggtagtttatactttacagagtgtgttccatgaacccagcttttttatattgaggcacattttcacatgtccatactgaaaatcacaacacattcagatttcaataatcaaaagtcatctcattgaacttcattgagtttttacaatgccggtggtttcaaagtgatattaatatgtggttttaaattagatcacaaaaattgcttttcttttaaatagaaaatgttatcaatcacacggatgaagaaggatttactcccctgatgtgggctgcggcacatgggcaaatagctgtggtagagttcctacttcagaatgtaagaaaaatgctcagaaaatatgtatgtgtagtttctggagctcagttaagtctttagtgcagtatttatatctgcagccaagcagacataaaggtggagggtacactgccttggttcttgtggaacctgggtctagctgggaaagcagtggtagccatatatgaaacagtgagaagaactgaatgtctagcccctctgagtagagcaggaacagaagtgctgttcacaggtcctggagggaaaggctcctggggtgggggtcggggggtgaggcttttcagagggaaggagactaagtaatgaggcagctggagagagggaggcaaggaggcaggcatccaggcagtttgggttacaagcaccatctatcacttttctgttatttcctcattaatcctagaatgtggcccagcctcagtgttaaactgtagtcgtattgacaaagacaagtgttcttgtttaaattaattggaagtcctctgtgttcacttcccatgacagggtgcagatccccagcttttaggaaaaggtcgagaaagtgcgctgtcattagcctgtagtaaaggctacacggatattgtcaaaatgctgcttgactgtggagttgatgtaaatgagtatgactgggtgagttcacacgttgaattgaaaactgctgtaacaagcctgtacctccattgttaaagtgccagcttagcacgcaagggcccagtgttcaaaccctagagataggaagataaagattatctttggctggcttcatggctatttcaaagccacaggactacttgaaaccttgcctcaaaaataaataaataaaataaattattgtaatattttttggattgaattgatttcagggagacataagctttattaaggacttggaagaaaaaatgtacttacttaagatgagcaacttaatgtcataaattcaattattgcttgtgacttatatttttcacaaagtattaatattattttaaactacttctacatgcccagtgccattgcagcatttgattgactgttgctcagtgagaaatgctgatgaccttttcctcctgcagaacggagggacacctttgctttatgccgtccatgggaatcacgtgaagtgtgtaaagatgctgctaggtaagcaggtgaatacagtcattattcagaagccctgggagcattttatttgcaatgtccctgttcggacaagcttacctagtgctcggatgtattaccctgcggcgtttgctcctgggtttcctttaccacggggctgccctgagagaggcagctccatcatactgcacactgcacttgaagattttgcccttcctgctcacatctggggtcacctttgactccagtctggtgttctccatgcacagtttctttgagtataagttgtttatgagcttcaactactctagagacgtttaggtaccttctccagccaccagatgaactctgtatcccatgcgctcaggactttgtatgagcatgttgcaaatagcctccgcattggctgaaatctgttcaaccatttgcatatgagccacgaatagacagacatttgcattttcatcttatttatatagatttttctgttttgatacagaaaacggagctgacccaacaattgaaacagattctggatacaattctatggatttagctgtagctttgggctatagaagtggtgagtattttagagctctcaggtttcattttaggaagactttatatatagtaattgccagtgatccaaacctttttcatcacttcatgggtaaaacattatattatcctaactctggccatatgctttaacggagtgcaaagtaaacagatgtctatagagttaagaaatgaattaacttattgttctttttcataagctgaaataatagttactggaggaaaagtgggcagtatttgcaaggttttcaaaaatggtactttggagtcttcacttttaaaaaaaaaaaaaaaagtggtaaaacctcagtagagaaaacacagaagctcaggcagctgctgaattaggaactacataacagtcctacttagaaatagcagaaatagcttcattttacaaaatacccaggctaagttgaatttatagagcagcagccttttgtttgcttgactttgctttgtttctgtgctgtgaccttggtggcctgtctttgcagttcaacaggtcattgagtcacatctcctgaagctgcttcaaaacatcaaggagtgatgcaacccttagaaaatgccagctgcccttctcttcacttcttggtccttataaatgataattctgtttacgtgtaaatttttacctcagttgcaatatttgctggtttttagtgagttttaataaatattcctctgaataattcactggtttataataaagttaatcctgatttttattttaaaataatttttaaacaaatgtgtttactatatatttaaagttataaattaatgttttatggcatgtaaatttttatggtacaggtggttatgtgtctttgtattaagtaccaaaatttgacactttgagaaattccaccctgtttatcttcactcttgtattaactctctgactttgcacagggcttactgtaagtctatgggagaaaaaaataatgttcttgttgaattaaaaagtatacagtatgatggtttacaaaatcatgtttaaataaaatacttctgctgtctgtgcattctagctctttgattatgtttagcaagattttcagtttatcatttatgttctacaaatcaatcaacaaagtacctttagaacattgttctcttataaattggtttgagaaggaaaagtcattatgaaatacattatgaaataatgtatatgaaattaatcaaatacattatgaaagagatgtgaggatgctctttaaccctactggaggaaaaccattaacttgccttttactaaaatctagaagagggagccacgaactgtaaagtgatttgactgactgtgagacttgattgagttaaatcccttcctctgcaaagtagatattatatcagttgtaacccacatgaattgatctgtatagtataaacaaaagagagctaagtgggactgaaaagatgccttggcagttaaaagcactggtcacttttgcagaggactgggatttggttcccagcacctacatggcagctcacaaatcgttaactccagtttcagggggatccagcactctatgtgtataaccattgcatgcatgtggtgcccatacaaatatgcaggcaaatattcattcacataaaattttttaaagttatgttacaggtaatattaggtacaattgctgagttatatgcaaatcttgtccatatacttacactttggggcgggggggtctctgcagtcactctggccagcagaccaacagtctgcaagaggtgtgaaagttcagttcaacatgactaagtagccactgttggttcaaactgagagtctgacaccaagtagactattttagggacattgaagcatagcacaatttgttctggataagtacacagaactgaagttccctttgtcctttcatcggggcctctgagaaagtcttcgattggtctggctccccacttaaaagcctcgtgttttcccacagatccagagctttccatgacttaagaatgaaggtcaaaatgagtttctgctcagcagtctttggaacaaactgcagggcttctgaagcctgaattattgttcttctgttctaggttagggccctaagcccaagaagttcttcccacatcttaccaccatatcagctaatcagcgtaaattcctcttttctttaaggtctgcacaatgtgctaagagatctctgccttcttttctttttattttatttatttggaaagataggagcatgtgctcacaagaatgcacatataccatggcacacattgaaaggtcaggggacaatttacaggagccagttctctcctcccaccatgtgagttccaggattgaactcaggttgctgggcttgacagcaaacactattacctgctatggagtgtaacagctgttcaagagatgatgtccaggagtctgtcactgataccatcagtgatgggatctgggacacccttctacagggctttctataaggctctgcaagttagaggttctgggattaaaagaaccttcaggtgtgcttccagtaaaggcagaacaatctaagacaggacagttaaaagccagttttgtagcactctgtggttatttcatgagcaatttgccagtgcctcttctgagggtaagaacctatttcaggtagcaagggtgttaatgaaacttggaggatttttccacaaaaatgcatgctatctggaatgtttacactcacagcatttcactgttgggaaggctaagcatcacttctaagcagttattcctcccatttccactacaagccagtcagaatcatgttcttttaatatcagagacattataatcagatgtgttgctatgttttagagttaagaaatactttatacttcagtgacagataaagacatgtctcagttccagacatagatgcacagagagccatatggaagaaagcaaacaaaacaaaacaaaacaaaaaacccaaagaactctctatctccctctctctcttcctgcttatttatttatttatttgttagggatggaacgcagggctttgctcagcctttttgagcattttttttttcaaattgtttccttttgttttaaataaaattgtgtttcatgtcacaaacacttggccctagccctgggttacataacactaggctaatggtggaagaaagtgaacagtggcttcaggcaaacggaattagaatcaactacacaagagacaaagacagtgatttttgacacagtgtgtgggattctttatctttcctctctttttctctagagcatgggattcttgactgacttgaggctacatatagacaaacagaccaaaccagactacacaaaaccaaagtcactagtaagtgggatttctgtcacctgctactgaggacagatgttatacacagcttctgttatgctatgtataacagatgtatatctctgttatacatccagcagggatcaccaacagcagaccacaaaggctaacccccaggctggagagatggctcagggattaacagtttatgagaactggcattcagagttcaaagactggcatccatgcaacaagcctataatcccagctagaaaggaggccgagactggagaatgactggggcttgctggcttccagcctagcccagacaacacgagcccaaggttcagggagattcccctgcctcagccagacagaagatgagaaaggaggacacctggcactctctttaggcctccatgcaagcacacaggcatggacagtcctctcccacacctcataaatgtgtacatatactcacacagatacaaacatacatgaataaactaataataaaaaataatttctaaaaagctaataatccccttcacttagccatcaatagataatattttcataaatgtgtgcaaagttgaaagaaaaacaaatacataaactctgaagatggtagcaagacctggaatcagaaaagctaaatttctgttgctccctggactatccttcaaggtcaagggaacctgtgcaagtaagtaagcccatgtggccccaacatttaatactttcaaacaccagcaagtgacctttaaactgttcccagatcattttcaaaagactacaaagacaggacaccttcatacaactaagcctgtgacaaatactttaatcttttcatgaataacggaagaagtcagggagaagctaaactagctgaacattatgacatacccctttagttctatcactcaggaggcagaagcagatcgctgagtctgaggccagcctcgtctacacagtgagttccaggaaagccagggctacacagagagatcctttctcaaaaaaaaaaaaaaaaagttaaaactggccctgactccatataagatgctggggaactgggctgaccttgagataagattgctggtcatatataaacctagctaatgagcaacaggaacctacactgcatcgaatggctcattcccacagtctagaacttgttttgttttacagataaaaatctccaaagtggggcaggagagacagcttttctgattctcagtacccacacagtggctggtaaccatctgcactccagctccagggcattctacgccttcttccagcctccaatagcaccaggcatgcaaatgctacacagataacatgcagcaaaacccccatacatgtaagagttcttaacaatttaaaacctatgaagcaacctgtaatttcactcagtctgtggcctttaacaaacagtgactatttaatcagattctgtttctccagataatcctctgggggactttgtcccatatgacattgaaagaacatgtcaccatgacctgttaagacttcagggaaagcatggctggggttaaggaaatcaccctggtgattaatctcccttctttcatcagctgatggtaaacgaatacaggtgccctgaagtgttggtgacaacgcttgtcttacatcaccctgcttatatgagacggcatagtgggtccaggagtcacctcagggaaagaagtggaaaactggagatctgcaggaaaaaaggttaaggttttaatatgcttgatcattataaaaataaatgcctgggcgtttaaggaaaatagtagtggatggattttctgagtttgtcactctgaaattttctttggaatgtcagcctcctgtatgggtaagattttattgcaatactttttaacacttttaattctgttcttagcacaaagtgttcatatattcttatactattgatagatgatagatagatagatagatagatgatagatagatgataggtgatacacacatacatgcataagatagatgctttgtcaggttataccatttaccatttataatccagttggggcaaggaatctactcttagatcttaaaagatttgctgtgtgaaaactaaaatgtttgcaaatctgatagcttgaaagaattgctacacaaactctggctattgtaaacccataagtattctttttcatcttttttttttttgtgtgtgtgtgtatgtgtgtgtggcaagactcctcaaattacttgcctaatgacagtctcataagtttgccttctcactcgtaaaattccaaattgtagctataccttcttgtatttttaaaaataatttatttatttttattttatgttctttggtgttttgcctacatatgtgtctgtgggagggggtcaaatcccctagaactggagttacagacagctgtgaactgtcatgtgggtgctgggaattgaacctgggtcctctagaagaacagtcagtgcacttaacactgagccatctttccagccccaacattttttatattttgttgctaataaatttttaaaatgtatgtgtatttgtttcataacagaaagtaacaatagccaggtctgtaacctcaactccttggaaggttgaggcaggaaaattgcaagtataagccttcctgggctgcagtatgaattcaagaccagtcagacaacttagtgagattctgtcccaaaagagagagaaaaatatgactgtgtttatagctaggtggtgggatccttgtctggcatatgtaaggcctctacatgcactagcatgtccatggtgcacatacatacatgcaaggcacatatatatgtataaaatataaagtaaaatttaaggaataacttttttgaaaaataacataggaggctggagagatggctcagcagttaagagcactagctgttcttccagaggtcatgagtttaattcccagcaaccacatggtggttcacagccactacagtgggatctgatgctctcacttggtatgcagtcatacatgaagacagagcatgcataaaataaataaataaatctttaaaaaacataatacaggcactagagagagaactcagaggttaagaccaattgttgctctgacagaagacctgggttccattcccagaacccacatggtggctcacaatggtctataaatccagtcccaggggagcaaatgccttctgccctccaagggcaccaggcacgtatgtgaggcacacatatatgtgcagacaaaacactcatacacataaaataataagagaagataaatctaaaaaattacttaacatttatcatgttattgaatccataacagaaatcaagaaatgttttcctacctaggcagtggttgagtacacctttaatcccagcacttgggaggcagaggcagaggcagagaggtctctgtgagttcgaggccagcctggtctacaaagtgagttccaggacaaccagagctattacctagagaaaccctgtctcgaaagaaagaaagaaagaaagaaagaaagaaagaaagaaagaaagaaagaaatgcttcactattggtgcttctatggtcttttgatttgagagggtcagaagtgtgactattactctgggaacagttacaattcatttcctgctgaattctctcaataaaatgagacctctatacatacaggtctggattcacagatgcacttgactactagaaataaccaaaataaccaagattgcctctgtattgaacatctgcagactttttcgcatctcattattccctgtgaaggaaccggcttcccttttggcagccataacagccgaacatgtgcttgccatatacctgccttggtcacttagaggtcagatgcctgtctcgtgacaaggaaccttagtcacttagaggtcagatgcctgtctcgtgacaaggaaccttagtcacttagaggtcagatgcctgtctcgtgacaaggaaccttagtcacttagaggtcagatgcctgtctcgtgacaaggaaccttagtcacttagaggtcagatgcctgtctcgtgacaaggaaccttagtcacttagaggtcagatgcctgtcttgtgacaaggaaccaatcagaagttagctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacccgagctaacatggggttagttcgttaaattacaataaagcctcgtgcagtttgcagcaagctctcgaatccgcctggtgattggggtgaccgcgaacctggcctgagaccccggatacttgagttttcgggggtctaacacctgcaagcaactacttaaccatccttcacactgcattatctagagatgacgaagtagatgagaagacgtggataaattgtacatatatactggcacacattactttatggacttgagcatctgtccatttgggcgtcaactttaggaattactgggtccagtcccctgtggatgcacagggaggagtatgcatgaaacaacatggtatgtttagtctccaaaatggcagattcacttgagttactttatgggcacatagtatctgaaacaattagttattttgatattttccctcccccaagccagtggggacaggttctagcaagatatgttacatctcccagaatccacttgtgaaaaacctcataattatctttgtggtgttcagtccagctgttcatcatctcttccccataaagtattaggagattactctaaatgtcattaattcttcagcatgaattaccccatgctacagttaccaatacaactccctctccctgggacctacatgattccatctcccaggtgatctctcctgaaccatgcatcctaaaacatcatgttaatcgatgtcaggttcctcagataccagtttgtaccaaggaaagctaatgagcttccttcctgttttctgctctagaggttcctataacagaggagcggctttcactgaggcactggccttcgggattcatggcggctcacagggttcacccacaaagccaggtaactcctccaaggtgcactcccattacgaaatctcttcctgggatgttctggggtttccttgccacagagatgggcagtggtaataaagccaattgctggtgatcttggcttagtgagaacccagcttctgagcccctcagatgtttgagaaatggttgttaagaatttaacagcccacctacctggccaagtcagagtttagcatcctggccttttccagagaacaagccactctctctgccgttccaggtcctggaccacaacacttgtattcatgacaatcccaaatagaaacaacccaattagttttcaagattgtattttattttaattatgtgtctatctgtgtaagagtgtgtgcatgtgaatgcagatttctgaggagaccagaagaggtcacacgatcccctgaaactagagctacaggcaacagtgagccactcgatgtggttactgggaacccaattgcaatcatcagcaaaagcagcatgtgcccttaccactgaaccatgtctccagccctgaggaccacccactggttacctctcaggtctccagccctgaggacccccaccccattgttacctctcatgtctcctgccgtgacaaccactattggttacctctattggaggaatgggagtcacacaggaacatgagggcaccctcaatcttgccttgggtagtgattacatggaaatgtgttcaaggtcaatcacactgtgcacatcacattcttatgctttcctatagacatttaagataaaaatcttaaagtatatgtaaggagtcatccccatcacaactaaactcagatggctgatgtacttttgttgtagagttgcttctctgtggatagttctttctggtgtgctacagtggagtaagagctggaaagtattaaacagttgatgatactacctgtgtcaaaggcaaggaaatggccgggcagcctcactgtaaagtccacgtgttccagcctattctgtagcccgtatgtgtataatggctgtcactgtgtgaaggcttcatctctctttcaggtgacaggaatctcttttcttcatcctgctggagatgtaccttcagatcagcatcataaaagaggtgatgtttctacctttaaaaaaaaaaaaacaaaaacaaaaaactaggatcctctacaagagcaaccctgctgagccatcttcccagcctctaatgccagcctatatatatattttactttgttgaaatctcagctttcatatattctttttacttcacagaattctttctttagttggttttagtgttttgaggcaggctctcactagatagctcaggctggccttgaactcatggtcctctgtctctgcctcctgagtgctagggccatagacatgtgctacctcgctgacttgttttctaagaatgctctttgtgtgtgtggtgtcttcccgtctcctccccacacatcatcatctgtccccaggggagtgtttagtgattagttatttcacattttaccctgccacctgaattaactttcctcaggtcatcctcaaaagcatccatgtggactggagatagagcccagtcacagaccacggtgatagaatgcaggcagccctcagtttgattcctgggactgcatgtactgtacatggtggcacatgcttgaaaccccagcacttgggagacaggcagttcaaggccatcctcgaagaccttgactacacagtgaatttgagatcagcctgggctacatgagaccctgtctgggaaagcaagtacactgcatctgtgtgatggtttaagtgagatatccatctcccagagattcagatgtttcaatacttggttcccagttggtgacactgtttagcggggtttaggaggtatggaggtgtgtcactggggggtgaacattgaggtttctaagccatacaccaatcccagttttctctctgtggtttacgatgggagctctcagcttgcttcagccaccaggcctgtcttctgccacacttccctggcatgaccataatggaccgggaactcttgccttcgtcatgacactttatcacagcaatgaaaaagtaactaatactttctgtctgtttggggcctccgtctgttaaagcatgcagaacttattctctagtgaagggcttattcatcctgaccacgaggacagacgtggagttggcttttgagagccccgggtagcgtgcacttaagcttgttttctactttctgcctcactctacctgcagcatgcctgctgcctctaaacccatagctcctgtgctctctagaaatcaagcctgaagattcagttgccccgctgcctagagagagacaggacccaaattccagctgttctccagacagactccaaagtgnnnnnnnnnnnnnnnnnnnnnnnnncccccaccccctgccctgcccctgcttccatgcttctcctcatccttgatgctttctgagagtagagaggaacagttatctggctcttcatcacactgtcataaagatctttagccatcaccaaactaaactctttgaggtcattgtcgctccttctactttcaatcaccaagtgccatagctgagacggtgtgtcagccattttttttacacaggaatcactctgccttttcttccacttgtcctagatcacatgtgaaagaaagtgagcagaaatacctttgtcctgtcttcttaggaaccatatccattcgctttcccaaagccaattgccagacactgtttgttctctgtaacaaacaagcatggaaactcctaaacatatttgctgttacctgagctatcacacatcagcacttctagaacttttcacagtctgatgtgtacctagaaactcacaaaaatatacttggcactgggcagaaagagatttccttttcctccatgtcagccatctatcggtctgttctcactgcatagtttataagcacacaagtcagtataattgaaggtccctgaaaagccagccagtcttcagagaagttaataagacttgacccattccatggagacaaaaagaggtaatggttcaaaagcagctgaaatgtcaacaggacttgcaaaaggccaatcagcaaccccagaataaaaacgctgagttggtggtaatcttgggcagctgaagacagaagtgtattacaaagaattcaagacaaagttctggtgctgaaaagcttagctttgatgatctggagaggcaagagaaatagtcctgagctatttcccactttagaaagattttgtttatcctttttcgctagagttggagccaaatttgagttagttcttaatattcctggccactcgagcactcaagtcaatggtgcatttctgggaacagcctgtcaccacagactacaggctgagacagaaagagcctgtccatgtgacaagctttctccttttcatcactttgaccaacgactctaggacactggtacagtgcactgtgttcttcccagggactccgagttctcagctatgcattgtttctttacctgccttgctgtgagaggcaagacccttagagttgagtgaccattcttaataaacattccagtcacattaacacgaaggcagacagaaaaacaagctgatggcacacacctctaatcccagtgctgggaagtagaggcagacaaatctttgagactttaagaacagcctgatccacccaacagagctagtttccaggactacataatgagttcctgctccaatacataaataaaacacagaattagatgattcttgagaacaaagactgagtcctttcatttggaaacccattttagtccatctgtgaatctactcattcatcttataagtgattccatttacaatctctataagatttgccacacagtgaaaaggcatgaagctttaaaaatcaaatgtctggatccaactcctgatgtcatggtgtttttaaagtcctcggttttctttctctgacaataaagctaaggacttgtcttggcaagattgttttgagggtttgaaataatgtacctaaagttactggcgtataataagcactcgatgaaagagagtggcggctgtgactgtcatacattattatgtcgctctgttgagccagacaggcctatccagcttccatatccacctaaggaggctgttttatccctaaagactcattctcactaccttgtgactgactcatccaaactgaaagaggtctcagtccctgacaaagactttctctttaaaccacagttacctgactctgtaagtaggctcactcgcttgacctctgcctgctgtcttagttgctgttctattgctgtgaagagacaccatggccaaggcaacttttagtaggcaggcatggcactggacatgtagcctaaagcagagagagagctaactgggaatggcagggacttcagaaacttcaaagcccaccccagtagctcacctcctccaacaaggccacacccctaattcttcccaaacagttccaccaactggagcccaagcttcaaacagatgagccatttggggccattctcatccaaaccaccacacctgctacgctcaattttggcacaaaaatcttacatcaccgactaatgtcagatgtcattttgccctgtcatattgcctggtccctcattctgcatgctggctatacaatgctcagttctctctgtaatatgtagagttgagatctgcctgttttgcctactgcaactattttggatgaagtttttttttttcttaaaagagttcactccttatctccatgtgtctgtttcttactggacaatgcacatgaacttaacctctgatatggtttggatgtcatttgtcaccaaatattcacacactgggaccttgtttcctgttgtggtagagctgagagctggggaagccttttagaaatcaggcaaactatgaagttcttaatacactcatggctgatccatgagaagggctaagagaactcccatgggtcctccgagctctgatgagagcaggttgctatagaaacaagctccatccctgagtgactctggctttctggttcaatatgggatctccccctcacatgcactcccactgttgggacattgtctgccatgccatgaggtcctcactagagctcagccaatactgctgccatgcccttgaaccccagagttaaatagacctgttttctctataaagttagtctgcttcgagtactttattatagtaatataaaatgtattaatagagtcttcccatgccaggacatgccaccctgagagtccacttggtttctctgaagctgagctactgccagttggtataccgagctggacaaatgcctttctgatgatggaaggggcagagctggctccgcagatgcagttgcctccattgtaggctcagatctcctctacacacctgcctcagcctcaggaaacttctctgctcctctttgccacctcagtgcccccaaggcattgtccccctgtaaacctccacacatccttttagtatactacattactgagtcttcctatgatgaaaacaggcctatcttgttttcccaggtccttgagcctgggtgagtgactcactaatcttctgacagccttctctttagtgtgaatggcaggaactcctggatcagcttctcacacttatgtgtgcagtcaatcaggagtttatgctgaccatgaattttggagcctgcccatctgatcctgttttcctggtgacaacaatacctgggacatttgttaaatatacattacctggccttgcctctagatgctccaactttgggttgaggctctagaaacggaagctttgcaaatacttatcagggatgtcggggaagtgttcctgcaggcccagatatgttagggaaaggggagtggtatgaaaggaagaagggtggctggcgtagccattgctgggggtcacccagcttttccttggcaggtgcaagtccagcatcaggcgtgccctgtccagcatagcttagttatggaaacctgcctgggctgatgaaggaatggacaacggtcaaatacatgtacagaaaagctgggatctgatagaggggcaccaacgaggagacaattcagaactacctactacgtacagtagcacagcgggaggggttagatggtctcagttggaggtccctatatgtccctatagggaaacagtcttggtctcaggagggagatactgccaacataggccacggaccagaggaaggctttgtctgacctgagcctgacctaaggatggttttgccagctcccatgagtctgcagcattggtccttgtcaacaatacacgttcactcagggcccctacagctccccaccatcgcgtatcccatgcttggggaacgggaggctccgatcctaacaatcttggtgcctcattggcctatgggaacgcttcatgaggaatcatccctccagccatgcccctacagtttggtcttccatgtttgaaacaggatgatggcagccctgcgagaaacatacagctttcccgaactcttggtgtgggatttgtgtctctccaatgagcttcaatcgtaccataactttacccatttgatccccgggcccttcatgtgtaaaataaggtttattccactacattgaagccaaagctttttttcaaaagaagctgccaagctgagctgaaagtggggttgcatgcagtaagggaagagctggagtttatgttactggagagaagtgccggtactcattaatgaggtgccctctagtgggaaaggcaagcaaggaccctgtttcctcaaacccacttaaccggttactttgtacttctgggaaattaccctaattgccaccaagttgccctcatttttaattttgttatgttattttaatgcacgaaatcgtaaatgagccggcggtggtggcgcatgcctttaatcccagcacccggcagtcagaggcaggcggatctctgaattcgaagccagccaggcctacagagcttgttccagaacagctagggctaaacagagaaaccctgtctcaaaaaaacaaaacaaaacaaaaaaaaaacaaaaaaaaaaaaagaaaacaaaaccaaaaatcatacatgatgtgaagtgtcatgctttagatacttcggttagtctgtccaggctgccttaacaaagtacagcggactggatattttctaacagaagttctatagtctggaaaagccaagaccccggtaccagcagattcagggtctggtgaggaactcttcctgcttgcagcctctcagttagagtgtatgctgaatcatgcggtttctgaagtcttgatttttttttttttaatgaacactgttcctgttcatgaggatggacctgaccctctagagcagtggttctcaatctgtgggtcacaaccccttgggtgttgagtgaccctttcacgggggtcacctatcagatatgcaatatcagatatttatattaccattcataacagtagcaaaattacagttatgaagtagcaatgaaaataattttatggttggaggtcaccacagcatgaggaattataaaaagggtcacagcattaggaaggttgggaatcatggccctagaggctccttcgaaaatgtaaacactttttcacgtacaagttttggaggtacacaaactttcaaaccatagcatttgatatataattataggacaaggttaaaatccaattccacaaagctggtaaactagaaatttgtaatgcttgtttaacgttgatgggtaagtggatgacactgttctgcagaaactgcatggccaccttagggttagttaattagtcatgtctgatgttataatttagcttgtttttataacgtgagcttcaaactacaatccacagtatctgtgtgcacaagaaaagacatcccagccttgttcatggttcagcagaagcaaagcttctcctcgtggttctgtcagggaggaatgctggtatcagtctgtgccagggtactatcatagtgaaaaacaaatctgtaaaaatttggaggttttgtttttgaagatagggtttctctgttagctctggctgtctccgaacttgatctatagaccaactgacctcaaacccggagattcccctgcctctgcttcccaagtgcagggattaaaggcgtgagccaccacggctgggcttgatttgtaattcttgtaaagaagctccaggcctttgaacaactgtccagagatgctgtgtagttgagcatacaaggaacgctacctctcttccccttttttgacattcggctccaagtccaattctgtcacaaactaagtgttaaaggctggggcaagtttcacagctctgcgtctgttcctcccaccaatgctgcatctcacaggctcctgttgaaagtgaggtagggtatttgaacacatctacacctctagcctggttaccaaagggaaaacaccgtggtcacaaaggcagaagcaagcggctggaaatttacatctaaagactttaaaggtgctaacctgtcatcagcagtagtatattatgtgtttccgggtacgcccagtctttgtcctgtgagacgccctaacatgcacaaagtgctggctggttcgcaggaagctgacccaattgctcactgctgccctcttgagtgcataacttggattgcatgggatgctgcctagcctgcaaatgaggaaaagccgtgcaggcccaagacaaacgcttgtgggctcttcagctggacacctaacagtcatgctgtctgtgagtgcatgcgcatctgcttctgccgaacgattgaagagggaattggcacttcccacccttgccatctgccagtcccagtcccttcaggcctgcacaaacaaatcatttggaatgaagcctatctaactctctctctctctctctttctctcctctctctctctctcttctctctctccctctcctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaatcaaattcttttctaacttggcgctcataaatgcagcatttaaaagaaagtaatttcaactgagaagcatgggtgagaagacccagcagggttaagaagactacattagaacatctgtttttgcacgatgtttaatcctatccttgaatttctattttgcacgatggtttaatatatatatataatatatatatatattatatatattataaatatccataagtcctgaaggaatgctaattgcatttcatttagttattttgctgatgaaagaacagacaatcataaaaccttaagaagtattctagaagagtatattagtctttagagtaacaatttttccctttagaataatttttttgcagattttatttgaattagaaacataattgttttacatgacaatcccagtttcctctccttcccttcctcccctaccagcctcccccaactaaaaccctacctatcacataacctttctgctccccctggatggtgaggccttccatagggtgtcatcagagtctatcgtatctatcctttggtagagtaacaatttatagaatgaatcactatatatacagaaaggggattcataaaaatgatatacaggttacagtccagctagtccaacaatgatggaaggtccaaaaatccagcagtcattcagtccacaaggctggatgtctcagctggtcttcagtatgtgcctaaatcccaaagtaggctctaatgccagtaaaggaatgaagttcccagtggggtgagagtaagcagccaaagagcaaagtgtttccttcttccatgtccttgtatagactgccagcagaaggtgtggcccagattaaaggtggatcttcccaactcaaagatccagattagaagtgggtcttctggcttccaatgattgaattaagaaaagaccaactcttaaaagctgttctctgactcacatgctcactaaggagtgtgtaagtattcgcattatgctggccttcccctgtcacctggcagaatgcactcaggcagtaccctggtcagcccagggttccatgagtattagtctgcacgaaggtgcaaatgaccctttaaaagacagactcccacccactaatgctctctttctgctatttcctttctttttccagctctgctctcctctctcgttctgtctccctctgtctctgtttctctttacctcttttctctttcctcccttttctccctctcttttctaataaaacttcttactcaagctctgtctgcctgtaccccacctcgggtgcaatggtcccccacgcaggatccccttccagctttatgccatcattttaaacaaaagaacaacaatgtgagcatgcaggcacacacacacacacacacacacacacacacacagattgtacagccctgactatatcaccgttttataaattcatgcacttaatctctagcgattgctccctgcctttaggaagcagatgctggggtgtggtgtagcactaccaaacacttaggtttcctgtgatcaattacactctgtagaaagtctttgtacctaaagctttcttctgtgtatcagataatacgttaggacagagtgtcaacagtgagatgtcaaagcccactatttcacaggggcctctactctgtaatgacttgctctctttcatgtctctctgtgttgctgtgacaggtcacagctgccttcccaccagaaaatgtcttgtgacttcctgtgtggcatttcttgtacttggagttgtcgtcacagtgattgctgttgggatcacctttgggaagcctgcaagtatgtgtcaccacacacatgtatttacactgcggatgttccaaagtgggtgaacctactgatggggagtggttggcatgtgctatgtgccagccatcagccattttgcacatctcttgctgtcctcaactccgggaatgtgcctattatgggcagttatgaaggacactcagggagaaagacagcttgccctggatcatgtaactgtgaagtaaacaagaaagcgttctgactcaggtcagcccaattcttaagtatacacaggatacggtctctaccttcaaggaatttccactgtaaattgggcaatgggtggcggaataccgtataattagaaattagagagaactcagcaagcaccagtgatgaagggacatggaaatgaaagaattgaaactggaactgagccttgtagggacccttgagtttagactgtttcgggggcacaaaggacacggactttgtcttgcatcaaacctgaggtacgtgaggaagagatatgaaaaatagtgttaagaatccagttcaggtgtagggggaggggcaggtgggtcacaagctcaagtcagcctggactacatagcaagattatctcaagaccaaccaaccaaccacaaacaaacaaaaagtggcctcagtggatgaggtcacacttgctgccaagcctgatgacctgtgtcattcagccccacatggcagaaggagaaaatcaactcctgcaaatggttcttagaactccacgtgagcactgtggctggcatgtgcacacatgcacacaaataaataaataaatgtaaaggaattaaaaacaaaacctcatagtgagaaatgggtattgtctaaaaagtaaaaccattgcaattatacacatacacacgtgtataacctagctccctcccctaccttgcctctgctgtgatgtgcttttcttccattgctcatttgggtaactcctaagggtaaaagaccaaactcagatgtccccaggatctctctatactagacagtcccagccactagactctggatccatcactctgctttcccaacagcctagttaaggtcagtactgcagagacactggagccagcccatgctgtaggatgtgggcagtgcttcagtgaggaactttgcacacagaccttcattaaatctgtcctgccgtggacattagactttcttcagggtttaatgttccccacctgtgcttgactctgcccttctccttcataggcattgccccaggtactaacttcccaccagagtcacatctcattccatcctagtatcaatttttcagagggtccaaactgatatcaattccttcagatgaccagaactaaggattcttgtttctgaaaccacaatgcctttaccaattggatctgtttttatctgcctcttaattgttcaagttgaaaatgcaccatcatcaagtaaactccaagccaagtacctcagatatcgcccccactgtgtacccctttgcacagctgaaagggattatgggggaagacacaactatgctgagatacaagtgtcaccagtgttgtggaatattattttagctaggcaaagatgtcccacttgtttatgctactgaacattacttttaactgtgtaaaagtgtattacatatgtttatgctgcatttgtttaattatgtaacaaagtgttgcatttgtttcactttgcctgcctaagacacctgatcagtctaataaagagctgaatggccaatagctaggcagagaaaagaaataaataggagaattctaggcttgagagaataaaaggaataaagaaagagaacagggagaaaaagagggagaagcctggaacagaagccaggcagctgctagaaagacacaaagacagcaggaaagtaagaatgaaaggtaaaaagccccaaggcaaaaagtagataaagagaaacaggttggttaaagttaaaagagctagccagaaacaagcctaagctaggcctagcattcataactaataagcctgatacacaccagtatttctataacttccatcagtttggttttttttcccatagcacttgagatttttaaaaagacctttccctttcaaataggtagattccgttatattttaaaatactatcatgtgggggctgagggtgtagcccagtggtaaaatacttgcctagaatataggaagtcctaggttttatcccagctctacaaacttgtggaggcctggtgtcacaaacttgtgatcacagtactccagaggtagaggctggaggatcatgttcaatgtcagtgattcgaaaatcaatctgagctaagacatgttgtctcatcattggtcatcatcatcttaatcagaggcgaggttgtaacttgctggtagatccctttcccagtattcgtaagaacctaagttcaatctccaggacctccaaaacaaaaatcttaatttaattttactcacaatacgaccatgaggttgacatagcaagttacctcagctaagaaaaataatagacaggactgtaatatccaatccgttacagagctcataccggggaccaggcctgttgacctctcagctgcctgccattacctcttgctgggactgagtctacacttgtttgccagatgccaatggttttgagggaaaaggaagaaccatcaagttaagaaggcctatctctggagagttttggagtatgggtgggaaagaaagaagggggaagaaatattggggacagtggcacaaagcaggtgaggatacctggcattcttgcatctttcagatcagctgtctcaccaatgcagaacagcttcacagcaaccaggcttcctgtgtgaggaccacaccacttgcttgctgccctctctgctttgtgatggcaagatggactgtggagatggtggagatgaatctgccacctactgtggtgaggtggactgaagttggttgtttttagtctcttattcttactctttgaggacctgccacccagctcccaaataaatacacagaggcttattgtttcttatgaatgcctgcattagcttggcttatttctagccagcttttcttaaattatcccgtctaaattttgcctctgggcttttaccttcctctatcctatatacctatttttactttttactacatgacttgctgtgtagctgggtggctggctcctgctgtcatttctccttcttctccccccccccatctctctccccagatttctcctcccatttattctttctgcctgacagccctgcctatttctctctgctgcctagctattggccattcagctctttattaaaccaatcaggtattttaggcaggcaaagtaacacagggtttttaattaatgtttgtacttaaggagcttcaatttagaattatttttaagcaaatgagttaaataaatgtaacctaaaagaatgcaacacatctttgcatcattaaacaaatattccacagcataaatgaacagaaccatcaagttaagaaggcctatgccaccaggcagtggtggcacacacctttaatcccagcacttgggaggcagaggcaggtggatctttgtgaatttgaggccagggcagaggcaggtggatctctgtcaatttgaggccagcctggtctacagagttagttccaggacagccaggactgttacacagagaaaccctgtctcagaaataagtttaaacaaagcagctaaaatatgtacatgtagctactatttaagaactataaggtaaccctatgcagtcttaaattcagctgtgctaagtttcagacagtcaagcctacacaggaaaaccctgtctggggggtggggaggaggggagcctatgcctggagagttttggagcatgggtaggaaagaaaaaaaaagaagaaataatggggacagtggcacaaagcaggtgatatccagcattcttgcagctttcagattggatgtatcaccaattcagaacagccctatgatggattaggtatacagtcctgtctattattttcttaaactaatattctacaacagtagacaaagtaaagaacaatagccagggctgggcaatgtggcccatgtgtttaatcccagcacttgggaggcagaggcaggtgggtctctgagttcacggctaggtctacacagtaagaccctgtctttaaagcagtagggtagtagtagtagtagtagtaagataaacttcagaactaccatttaaacattttcatgaataatttttccactataaataatttatttatacaatataggtcaaatgcccaacagtctcccaccaaacttgattttcaagtgtcccaaccagaagacatggatatatgtggacagggtgtgtgacacaaagaatgactgcggtgactgctcagatgagtcaggtaaaaacgaaaattccatagttgatctttttaatgggttctgggagtggctgcccttacacttcaattacacaaattagccctaacttagaaaccttctacaggggatttacacacacagactaagaaattctatcattccctaggccgcagggaatgccaaggtagagagcaggcttaggcaggctgaggatcctggcttccattcctagccccaccaccaaaaacaaataggaaggagatagacagggagagaagaaaggaagatagcaggaggaaacaagaggggaaggaggaagagggagggaactatattatttcattagttcatgtctatttcaagtaaacaagttctctagcaaggaagttaacaaagtcagttttgcaagaaaatgttaacagaaagctctcatctattatcaactttcacttgggtttctctggcaattcttcaagatatacaaaagttttgttcagtgttttagctctcaaaaaactagttgttaacctggtcatttcttcctcactttcatccttgtcccccatcatgttcccaacatggcttaacactgagctgcaaagatccctacttcacaagcaggcaagaccccaacccgtaggcagtccagtgcatgatggctccaactgatacactggaagcggcatcagaaacacacagatctgctctttgccagtggtggagggtagaatgaaaacacatttttgtagttaggaaggagagggatggatgtgtgaagagggcctttgcttctggctagctgacaattagcaaaggcctgttcccctgctgactgattgccccaactcaaggggacccttccctgtttactcaccatgtcagtatgtttagtttgggctgatgggtagaggcagtttcgtctctggcttttcaaactatgtgtagaatcttcagcaatcatctgctgattttcccatgatagtttcactgatttttttttttaaacctaaagggttatttcttgtccaatagtatttttttcccagttgacattttaagttatgcttttaaaaataaatacaattgtctagtttcacagagcccagcgtgctcaggctggagatgtgatactgttttcttcgctgactgtgcctgcattcccagaagtcgctgcagaaacggcatccaagactgtactgactggagtgatgaaaacctgtgtgattaggtttataatcgaggtttcagaaaagctgaaaaatgcttcttgccctaagacttctctcaaagtatcggcgtgtctgtcttccatatttaccttcttggaatgtagggaaggaagaacctgtgcctcgttaaccaagaaaactggcagaaatcagatgcaactttaggtccctgttctaaatttgtttgcaaataaccacagggttatgtgggaagcacacacatgtactcttgttttaaccagtatgaaaacagttaccctaagaacttttagatggagatgcctagttcactagtgtttaatagccctggtcccagatctagcagaaaattaaatttttaaatgtttttaaattagtacataaagtattagaagtcattatggcatttttcaaagtgtgttttaagtagatagcctccatgctctttttaacttcccctgtagtctccttcccatgtgtcctttttgtctccatctcctccttcctcaacatctctttaccctctcttggtctcttctagcttttgaaggctttatgttaatattgtgttcaggtatatattacaagctaggatctgcatattagagaatgtagtttttatctgagtttgggacccattttcctggaatttttatctttcttcacagtggaataaaattccattgaacatctataccacaattttcattatccatgtgtggatgatcatctagcctggctccatttccgtgctactgtgaacataggagtaatgaacctgaatgtacaagtatcttggtaggatacacaattctgagtacatatagccaggaatagtatagctgggtcacatggtagttattttgggggaaacacccttactgatttccataatggctgtcatcattggcactccctgcaatataattaagggttcctctttcctacatccttgccagaatttgatgtcaggtttcttgaaggtggctgttctgactgggccaggtgcaacctctaagtagttcaatttgcatttccctgaaggctagggagaaaaccagccttaacagtcaagaaatcatcagcagaccagaacagtctccttcaaccttcaaggttctaacgtgattgtgctgtccttcaccagtagtaaccagaaactgtagacaaagaaaactgcaaggatatggtagattgtgctactgttactaacactactctaaacaaccctatgaccaccccagtgacagtgctgtcctctggctgatgtagtctgtggtattatgtgcatcacttccgagcctaagtttggggagccagctggtgatatgccaccttttctatcacaaggctggcaaggttctaattaaacgctgctcctgcaataaagtagaacagaagcaaacaaggcatcaaatgtgacgagcctttggagcttttttctgataatagagattatgaaggaaaatgtttccttattaatccacagctaccaacacactatcactcaatgaaaaaccagcaaaaacacttgcagaggctgaggaatcaactctggttagtgacagacccagctggaaacccttcctacagacctaaatcacagccagtcagcagccgtctctacaaactgaaggaatgtcactgtcaccttaagagttgacatcctgagacaaactgagaatgtttctagctcccactcacaacactccagctcagccattccatctgtttggattctaaaaatgagttttcccaggtaacagatttatcctatttcctatgccccatcattgggcaagctgtgtttacaaccaacctgacccacaaatgtctgggtgactaggatttttagctgttgagacctcaggacccttgttaccactgtagcagtcgaccttgagggatgactgcataattctgcacattcctcccaacttcacatttgatacaactaattctgcacagtaactctggaatgcagctgtacaacaccttaaaaggggagcttcgaaccacagtatatatttaaaaccatctcaatagtaaaggcaattttcagctctcttgttgttcgatgaagggacaaggggacttgctgggaatggtggaactggtcaatattctgattatggcagtctcagtgttaacatagagccttggaaattagtaactgaaagtatcaggttatacatacaaaatggagatactaattcatacctcataaagttagaataaaacgttaaaactgagatacagggctgtagagatggctcagcagttaagagcactgtctgctcttccagagaacacaggttccattcccagcacatacatacatacattcttacttatatacatggaggctcacaaccatctataagcccagttccagggatcctatactctcttctgacctctgcataaagataccatacacttacaataaataataccaagagaaaaagcatcctggtttacccacagaatactgttctcatagcacatccaccacacagagcatgaaagcccctagggttggtggagaagcaaactctccaatacactttcatttatcaccaaatgctatcattacaaccacacaccatgatcaactttctataaactgctttctctgtatagatgagtgtcgtcaaacaagccatatactaggcaaagaattttattaacccctttccaaactttattcccaggcttcttcagcttaatttgctgcaaagaatgaattgtgtttaagcaaaaactgaaaagagctgcagtgtccagggggcttgggcttaaaaatattaagagatctagattttatcagatccataaacaaaagaattttaaaaagcagtcatgatataaaatagcagctcctgtgacttctgcaagtgtcaccttcttcagaagtcgcctcaattcaatttgcctcgttcttagaagcctcatcaaaattctccaccagatctagaaaagaatcaaaacagacatcctgaaaaaaatccagctcaaaaaaacgtacaagtatttatggaaacaatctcaaatttaaacacttgccacctccaatgagactattttggcacagtaagtgtggtctggcatagctactggagtgaacatcatgcttaaaaaaatctattttatcctcaatttaagaactaaatacaacacacagattaatataacaggactaaagactaccatgacatgatctgagtctttcttgggtttcagggacatttgtagaaactagaaaatgtatgcatttttaaaaaattcctccacaggacataaactcaatgtaatttagttggacatgatgtcatttgtctgtaatcccagcactggagaggttgagtcagaagattctcaaatttgagctacatattgaaacaatgtttcaagtaaactaaaaaagaaaaacattgcccggcgttggtggcccacgctttaatcccaggacccaggaggcggaggcagtggcagcggcaggcggatctctgtgagtttgaggctagcctggtctccagagcaagtgccaggaaaaacattgctaaccaagttacttagctttagaattatcacaccaagatatttaaacctctcccataccatttcataaaccagtgtgtttcaaagtagcatcagtccctattcccttgaattctctggctttaacttattaccaccatcaccatcctggaactttttctgtaaaagattcatttttctcccttgccaaagtgattcttacctgggacctcatcatcatcatcctctccagtagcaagtggtgctttcccatccacagctgagaaagaaacatgaaaatgtaaccaacccattttctctagatcaataaacatcaaccacaagaacatatgaaacaccaagtcacaactcacatttgtgatggaagtgacattgaattttcacctatagtcccattaacaagaaattgtgatgggcacaaactactgaaacacaggtaacagtaactctgaatacattgagaacagtgattagggagcgctcaaagatgaaaccacacaccaaattatagtcaggcttattttgggaggcaaatgaggaagccagccatttccctaaatattctgtgcatggcacaaagcccaatgaatattgaaataaaaacttaagccaaatgtggtgactcacacctatcaaccaccgaacttccgaatgcaaaggcaagactataagcgaactccataacagtccagcctacatggggagacctacctacctcaaaagccaagaaggggaggaacaaacaaaaaggacaaatttaaagtatctttcaactgttaactaaccactgttactcttttccttcccctttcctgaaatattaggaactgaattcagggccatgaacatgctagcaagaactctgccactgagcttcactaaccagcctatttttaataaatacattttaaagacagtttaatttgcccagtctttcaacacataaaagttccatcagtacaagtttcaaaagctggtctcaaagatcaagatgacctaaaacatcttgatgctcctcccttaacaataaaagcataaaatgagtcagcatctaacaaacagctgaggaaatagcaagccttagagtaagcctcttgacttgcttctgcattcatattcttaatttttaagccaaaacatcaagcataaagctgccacaccacctaggatgactaatcttggttaatttgacacccagggggaaggaccctaaatgcctccatcagatcagcctagtgacatgtatgtgctgcattttcttaattgataattgatgtaggagagaccagcccattgtagactagtgccattggtgggcaacttggcctggaataagaaaggctgtccagggccagatggtcagtcctgaaaacatacatgtaagtaacattatacacaccaaagaggttatatttaggaatgtgtgggtatacatacacccatacaataacaatgaaaaaaggttatgaatttaaaagagaacagggaaggttatatggtagggatgggggtgtgtgattataatctcaaaaataaaaagcagttgattgtgagcctgggagtgagccaataagcaacagtcctccatgggttgcctcaagctcccgccttggcttcctttgatgaactgtaaagtgcaatgaaataaacccctttctcctcaagttgcttttggtcatggcatttattacaacagaaatcaaagagaacacagcttgttgtacatgtaggttacagtctgccctaaacaaaaaccttaccaaactataatctgaaacaccaaaatatttattggtacctatcatctatgtcaacaataatttattatgtgtttataagtaattaagagccccaaaagataccaaacacaaagactgtaaataaggatatggaatgttagtattattcttgtttttttcttagacagcatgtttgtagcccaagctggtctggaatcctgtaattctccctagttcagcctctcaaagtgttaccaagtgtgagtcaccatgcccagcctgtcaattctaatcctaaaacctagcaaaactaagattaacagttttttttcatttctaactaaagttaagtttttagtgattcaaacctagcaagttggtaagaaacaagcatccacttaatcaagtataatgatcacagaaaaagtagacacatcactgtaaacgagaatgagtaaaagcagttagttaaagggtgtattattcttttaggcattctgtgtctaaggacattcttagcaattctgagcctgagatgacacaaatgtaactctgaggatactcacattgtttgggcaaagcttcagccagtctccttaaactagtcagactgtctgccccaagctggtttaggatgctgggaagcatttctgtcagctgctttgtctcagcgtggcctgtaatggtgaaagtgtttgctgccagagacgcctgaactttagggttgttaaaatggatcactgttccttggtttgtaaacatgttcacctataagaaaatacaattattataagtaatgctcaccaacaattcctttaaaatcagtttttataaaactataatatgtctgagttttccccctttgaagcacaggtgacaatttcccaggaatgtgtaatcaaataactgtctggcttcccaatctctcagatactcaaacatctaatggagcaccgactacattgctaacagcagaggcaagacaattacttaatatatgatcattaaaactttccagtttcgtggtgctttgacactcacctcttcaataccagagatgttgttcacccctaacttctttaaggagaactgcagttttttatcatctgctgtggctgttctgtgaaccaccttcttctttctgcgagcagttccctagtgggagaagggcagacagcacatttacacgacagcagtctatcctaattcttttcagacctttgcttctgtacaagttagttaaccagatagaacatggtggtgaccttgttcctttagtcccagcactcaagaggaggcagaggcaggtggatctctgttttgaggccagcctggtccacatagtgagtcccaggcaaaccacgaggctaggtttcaaataaaaacaaaacaaaaacccatagaattttaaaaatagtcaccaaacccacaaaccatgaagttaaaaaggcaggttacaacggaagtatgggaaaggaatgcttatgaattttttataagcactagtttgtaagatgcaaatggtcccttacaagtcctaacatttaagtcttttaaaaagtgatcagagatggcatgtgacaacttaaatgaaacttcatttataccttttgttttcaaagaaaaaccaaggccttaattaatactcacagagggaatagtaaacaaagtaaccaatgaatctgtatacagatgtctactacagcagagaggacaaaggtaaagttcttaaccaacccagatctttctaactgaagatcctctttgatgttccttaaaggagaacaggctagtgccctagtgcatctctgaatgctatccctcttccctgtactgttcagcttcctccctagagtacatttcttcttcacccaactagggacatccacaagcatcagtcttgcctaatttactttaagttattctcactcatttttcaaaatgctgttcaagctattattccatctgtcttcaaagccccaactctgcattaactgtatggcatgctaagccactcccaaatgtatactatgaaaagacttctataacactaagtacaccaccaccaggaaaagattagattctaccacctatagatttcacacatttcacaaatgtagaattcactacacttactcaaagaattgtcagcatttccattagacaccgaaaggggtcttgaataatattcacctgaaagcatgcaaatctaatactgcttttctcactcacactataaggtttcttaaaaggtacagaaagatgtccccatattatggctggaaacattttgtcttagcttaacaaatactagatacaaagtctactgtataagattaacttggaaggctttcgttttcccttagagatgcccctcaaagttaaaagccattagaggaaccaccttgcacatcactccaaaaactatactgaaagaaactgtcaccactgccccaaccccagcacccgaagggtactatgttaagataaaggataagaaacatccaatgttagtgtcgtgaatggaaactgaagattacaattgtcagcaaaggcaaatcaggtgtggatgttaactgttgatcaagtcagctaactaagcaaagctgtgtcttatttaagctatacgcaagatctggttatctcacagaaaactctcctgaaggtaaatgtttaaagttaggacaatttaataggtaataaactggtagaatggaagctccacaagttttaccaagtaaagacatgctctgattcaaccagcagacaccacaccttgttcaaaacttcggaatgtgctaacacaatacatgaaactaaggagatctccatcaggaactgacttcagattagcaaaccaaacaccagattcaataaagaatcttcattaagcttagtaaccaccaggagtaaccaattagccaacacattttttctcccactgtaggataattacaaagacagaacaaaaaaagaaatctaacaccgactattcatgaattccaaaaatatcccgttgagtatttagttcagaaagcattgctgaaaaggtcttaattaacgaaaataaatgttctactttctaagcattaagtagaacaacaacaaaaaaaacaccccaaaacattcgggggggggagcgcaatgaagtacatgcctagcatgaactagaacctgtgtctgatctccagcacagcttaaaataaagaaaaaataattcaccaattttgtacaactcaagggtagaggtgtacaatgatttggcagagaggaccttctcccccattaataaaattaaatatactttctgtttatatgttgtaatcttagaaacacgcaaattatgtttaagtgttattttcttctctactaaattacttgctaccaccccccccaatatacagcttccacgtttctttgtgtgtctcatctcttttggattggcaggcttttccaatttcccctgccaagcaaagtgacaaaacagcgtgagaaatgcaaagggaattttaaaaagtaaaaacaagaacaacaaacttactttcccaccgatgcgcacttgtgcctgcagcttggccagtttttcctggttcatgatcgtttctttcatctggaaaagagaggaaatcctcagcaaagaacggtcgggctcactccagcattccacgctcgttatttcccaagacacccgcaggagaacggcctccgcaggctgaggcctggatccccaaattcaccctacgaaactgcgaagtcggctcccagcgagcccggtgagcacaagcactctcgccactccccgcccccccttccaggcccagactcgggctcacccccacagcattccccccacccgcggccctggccggcctcggcctccccagggcctgcccggcccggccactctccgcaggcctcgcggtacctgaggctcctgtcctcgggttccgccgagaagtggaggaagagacggcgtcgcctcgcccccggggcagccgcccctggctcgccctcgcccccgagagtcagcctgagcgggagcgcctgtccgtcgcatcgctttcctctcctcagccctgtccctccctgtctcgctccagccgggaactgcccgcccccgctcccgtcctcctcccacgccggcgtccacagcctttttgtaccttgtcggagtggaaatggggccgcgcgggggactagggttcgcgctcaggggtctcgggcagaccagctgagataaggcgcacacacgcggggacgcaagatggcagctagagggtggccggaagtgacgcatcgccacttcctccggaactcaggggactcggcgtctctgcgcacgcgcggccggggccccgcggcgagggtgcgggttcggtgggctcccagttctttccttgtgtcccgcggcgtgccgagagcagcaccggagagctgtgaggcgcggacactggccgtcgtcctgggaaaggctccccgtggagctgtggttaagtcggtctgccctgtgtctccccccccaggacgtcccgctctgtccagtagacagcagtgtctgctcaatgccgggtgtaaatgaagaaaaggtatcaaaatcagggaagctaattgctttccagaattaggtggcttgagtgatgttgaaaatcgcaattcagaatttctagaaagcgtgttccgaattcatcccggtaccccacccctcagagcaattccatccattcaaggttgaaacacagtaacagatttctaatccccttaaccctccacaccacggcggtcgcgtacttaatttaatctctagtaggccaacggttgacttctcgatatcgattttgcgtggatttgaccatgaatcattcacaatggagcaaattttacggttagtaattgaatcagagacgaactggggcctgatgtgcttggagaaaaaagcgcggctgtgagttaaagtttgctgaactccagtacaaattgtgttttgtagtgtttgcgttttttgttgtgtggcgtgatggttgttttgaaaagtgtaggtagtcctggctagtcagaaatagctatcctccaaccttgggtttcccgtccggtgctgggattacaatcctgcagcaccatccccaaacaagttttaagacaaccttaaaaatcatctttgtggggggaaaaatataaattttagtgaaaattctgtgtagtcagccttcttgcaaatttagttttgggatgcttttgaatattcaaaagttaaagtgtgatagaaatttgagagaaaataaaatttatctgaaaaacctgtgtaagtgcatacccctctagctaaaatcagtttttttcttggaaaacttttttacaagaaagtttacaacagtgatgtgtcattatgaaaattggggggataactaggttgctttgtaaagtgattgtaacagtttttttgttttttcttttttgtttttgaaacaatgtttcttttatccagccggtaaatttatctcccagaaaaccgtgcttgttgtctaggctatgtagttacccggcctagccataaagatccaaataactgccaggcggtggtggcacatgcctttaatcccaatactcgggaggcagaggcaggtggatctcagtgagttggaggccagcctggtctacaaagtaagttctggggcagttacgactgttattcagagaaaccttattttgaaaaaagaaaaaaaaaatccaaaaactgaggtgaggcaacattatttagtgctacaagaaaatctataaaatatataactgttacatgtgatttataaaactcagaactagtcctttataaagaaatttatgtctataaaatattatatccttggtattatactgagggcatgtgaaacttttttttgttttttgtttttcgagacagggtttctctgtggctttggaggctgttctggtactagttcttgtagaccaggctggtctctaactcacagagacccgcctacctctgcctcccgagggctgggattaaaggcatgtgacacccagctgagggcatgttaaacttcttatccatgatgttttctaaatttttacttaaaaccctacatatgcaactgacacctgtttcttcttttataccaatattcaagaaatgtgatttattttattttcccttgttcctacagtcaagtgtacacaaaccttgtctcaaaacaaaccaacaaaagaactgaagagctttgttgttgtttttctcttcccccagtagttactactttgtagtcttcccacatgttcccaatgtctccagcaaatgtcaaaggttgactccccatcatttactgttcatataaaacagtgcaagaagtgcttatttagcatttgagatggtctctgtcaacagcatgtgagagaagggaaacatgtttgctcttcttgatttatagcctatgtctaatcaaaacccagaaattgttttcatctctgacctgaacttgagttggcttcagcaaaagccagatatttacttgacattatgcttaatccttttactaaattaaaaaaaaatgtgtgtattggtgggtttctcccaagccatctcacagtccatgttcctgtgcttttagatgcttgggaaccactaaaattcccttacatcctccttccagcatcactgtctctgccaagttaatatctatacactggctctccgagtctcaggaaaccttgctcagatacctttacctacactagtttacatctctttgccacagaaatcttgtttttcttgtagtcaccccgcccccaaattgtctgtgtgatgtcaggtagtgctttaacttgtatacacagtatatatattccacggagaatgtagccctgggggcacatggagcattagtgaggtgattgatacaaaccttggccggatgcagagaacagtcagtggccttgaaacatggtttgttcttttgcctcctcatccagttcagagaaaaaaataaattttccattggtagaacccacaaggtcttggaaggtagatctaactggtcaatattataaaatacatttaagaaaaactctcccagacctcctgacagcagtgtaagtactggctggcccagtggcctgacctctgtatctagatagggaaaggatgacccaggaaggatggcatcggtggacgtttatgatggggcagaggaagatctttcttcatccctgcttgctgcaaggaagtttctgagtgggtgaaagctgtgcacaaattgtctgctaaaaccaagtatggggttcaatgcaatgaacaagtcactttggggcccatgttcacacaggggcaagaaaacacaagaaacgtctgtttaacccctcagatggagacattgaccctacaagatgacctgtaacaatcgtctcacctcaaaccacagaccttcattgctgctgaggttggtaacacataactccactcttctcttccagacaaaccctagctcatcaacaacactgtggcagattccttactgagaggcagaaacatctgctgccaagaaggcagctattgaaggtgttcaggagcatatgactgagtcagagtcacaactgccagtttcacacatcctctgttgggccccacaggcaagcacagcagggttgtcttcctgcttgaaactctggctcagaccttggctctgttttatccagtgaaaatccttcagtattcctatcatgtccaaaaatcaaggggtggaagtatgggcggcaccattcactattgacagagcttgctctgtcctcctgcaatgtaatgctctcctggcttagaggccttagttccagaaagggaggccgcttcaccagaagagatagtagtgatctcactgagctgaaaattctatggtcacctggacactctgggttccttgtgccactgagtcaacagaagaaggaagctgagggttttttgtggggtactaactaccaaagagaagctgggctactactactccacagggaggaaaggaagagtgattcttgaatccagaggtccctaatgaaggtttaggtcactccattgggtaaagggccataccagctgaagttgccaaaggcaacaggaatatggtgtatagtagaaaattataattaccagctgtaaccacatggcaagttatagaaatgaggatattatatcattactatggcttctttttatgaaaaaaaaaatgtgtatttgattgtacattactgtgctggctagttttatgtcaacttgatacaagctaaagtcatctaagagaagggaacctctataaagaaaatgcctccataagattcagctgtgggcaagcctgtaaagtattttcttaaagtaatgaatggtggggtagggcccagtccattgtgggtggtgccacccctggactggtggtcctgggttctataagaaaaaaggctaagcaagctttgaggatcaagccagtaagcagcacccctccatggcctctgcatcagctcctgtctccaggttcctgccctcactgcttttgatatagaactgtggatgaaataaaccctttcctcccaaagtcgctttgggccatggtgttttcatcacagcagtggtaaacctaagactattacttactggttctttttctggaggacccttgtgaacacaagggacaccacattctaccaggaactgcacagtaggaaagaatcccctgggatctgaagggctggagtagctgagaatagaacacttcagaccaacagtaagaatgaagcataaagcaattaagaaggctagaaggggcctggccctgccccaacctgttgtgccagactatgttaactcctcataggagaccttaccagtgaggaagagtgcactgagtgtgggctggggggaaggtgagagggttgggaggaagcagggggatgggagggagaactgtggttggaatataaaatgaaataaaaaaatttaaaaaatataaaaaaacccacaaatttaagtgggacaaacaaaataaaagggggaaaaaaaggctagagcagtgctttctgaagcctaggactttaatcacatttttggtggttcccagttacatgaggcattatgcatcgatacaattatacttgaagggctctagcaggccggagtggcaaacatggcaccaacaggttttgcccttttcccctttctctcctcccccttgctgaaaactgttagattacattcctaaagctagcccccagggtctagttccttatttggccacagattcattcctcagactgaacaccaaggtccagcaatcaaagttcattattcggctaacatgtccaatcagaacttaccaactcaccctagcacagactcctccttttctccctaaaaacccactcctgcaaacacaactgctctcttgctgcttgctgtctgcccttgcccaatccagaggcagctccccacccctgcttgcccctccgggctaataatctcctttgtgctgagatgttggtgtttggggatgtcctgtacccattgagagtgggggcaccaacccctcccttactatactcattttagttctttcttaaaccctcttgtatggagaaaatgttctttggcaacaagtaacacacattgtaacatttggtaacctattaaagggagagcccatctacacttagcactctctgtagccacattacctagataggattaaacaatattttcctttcctttatggtgattgaaactaatttactgttttcagttgtgatagttttcttttcaggggctggaaaaatgactccttggttaagataatttgttgttcttgcagaggatggaagtttgagtccaaacacccacatgacagctctgcctgtaactccagttatatgccctttttgacttccagggcactaggcacacacatgcggtacacaggcatacatgcagttttaaaaacaaaactttaaaattcaagcacttaaaataatgtttaaaatattaaaaagaatagctttggttgtctaaaactaggcctatttgtgaaatcaacaaccaacacagtttttaaaacatgagagagaaaagttttcaaagttacttatctaggtgatattaaattggttgatactcgggcatcttagaaggtatgagacagtgtgtagttggctaaattttcaaagctatgcatgcaaagaaatggcaaaggatgagactactaagataaagaagcagttatgagggtactggaagacatgctaagaaccgggagtttaaccataaagtgaataaaggattcttggaaattgtgagctgcaaaagatgtctgttgacacaccccatgtccaaagatctgagtggggacaaaacaggggactccaggcttctgagatcaacaggagtacaagcaaagcacttgtcatttttataattaaaacaagcaaatgaagtgacatttacagttagcttaagcaaatacaggtagagcaagggaatgcacctggtgttccctctttggtcatgtgtacagagccaagaacattcctcccaggcctttgcctttccacatggaagctgcttgagggtaaggtagagtgatttcacaaataggcctagttttagacaaccaaagctattctttttaatattttaaacattattttaagtgcttgagagtttagcatctatgtattgcaccatgtgcacacatggtgttggaggaggtcagaagagggcacccattccctgagacaggagttacagacagttgcaaaccaccatacagagtcctctgcaagaggaacaaggactcttaatgaatgagccaactctccagccctcaaagctctttttgatgacttggtctatccccttaagtcagtggaagcctctgaagtacatacattagatccttttaagagctttcaacccaatgtagctggttgatgcagtttagccatgaacaaaatagctaccttagagatataaagtatggctcctctagatgtattagctatgccatgctaaaattttataggaatttagaatataatattactaataggataataggtatcaaaatatgagcattggaagtcagaataaaacgatgtcctcatcttccatgtgactcaggtaaagtacttcacatcccatgtcccgtccccctagatctggatgtacaacttgtggcaagatgctgcttcccacagactggcccaggtgtgattgccagctgctcaggagcagtggccacactcagttgtaggaccagatgctagacatctgtctcctattaaccaggatcaaaataaagccctgctcaagagctgacaatgtggaacatgtaacccaaacaaagatggccctgttgcctgtttagcaaagcatctaccacaggaacttcgatcttctcaacagctggagaaatcaagccctttcaatgtggccttttgctcctttgtctttttctctgaagctagactgccgttattttttcaactctccttttaagtcatttcctgctttagcctcccaaacagctgggactatgattatgcaccactactctcaacaacgatccccctttaaaattactatatgtttttttgtatgtgtatggtgttttgcttgcatataagtctgtgtaccatgtgcaagcctggtacccacagaggttaaaaaagggcattgtgagctaccatgtggtactgggaatggaaccttggtctttattattattattattattattattattattattattattattattattattttatttggtttttcaagacaaggtttctctttgtaacatccctgactgtccaggaactctctttgtagaccaggctggcctggaactcacagagatatgtctgcctctgcctcctaagtgctgggattaaaggcatgtgccaccacactcagcttagaacctttgttctttagaagatcagccagtgctcttaacctctgagccatctcttcagtcctgatcccaattttgttcatcagttactaaggctgatagaatgaaacacaacaggctgtgacttcacctcctgtggtggtcaacattacataatctagaatcttctgggaggcaggccttcagaaacacctgaagatagctcctgagatatctatgggagacagtcttgattgtctttttgttttttgagttttggggttttgggttttttgttgtttgttgttgttgttgttgttgtttttgtattttgagacagtgtctctctgtcctggaactcactctgtagaccaggctagacttgaactcacagagattcacctgcctctgccctgatgatcttaattgatgcaggaagacccatttgaactgtggggagaaccattccttgcttagggagcttgtgctgtataaagtgaaaaaagtgagctgaaatattattcatttactggtggtggacttaatgctactagctgttttgtgtgctccttgccttgaatttcccaccatgatggatttctcacagtgccttcaaccgtgagctaaaataaatccactcttcctgaagttggtattttattactgcaatggtagaaggaacatcctcccaatggctgatgcagttcaatagaaaggtggttactgttaactgattatgcaccaagagaacagagtggctcatcttttagttcctgtgtctctgtcttttagattttagttgttttagcaggaaaaaaattgagtaatgaaaatcactggggtaactactgtcttagttaagctttctattgctgtgatgaaacatcatgaccaaaagcaagttggagaggaaagggtttattttgcttacatttccccatcactattcatcatcaaaggaagttagggtaggagcctggaggcaggagctcatgcagaggccatggctgctgcttattgacttgctcagtcagtctgctttcttatagaatccaggattaccagtccatggatggcaccacccacaccaggctgggccctcccacatcaatctttaattaaaatgcctccataggcaagcttgtaaggcattttcttaattgagagtccctcttctcagatgactatagcttatgccaagctaacataaaaccagcaggcacaactacagtcaacaaaaacctattgtgtattttataagtaaatagaaggagaggagttggaaggctccaaaccaaagtaataaggaaatgggaatggcaattagtctgttttgataagtacacattgtatacaagtattgaaaatcaatgtactccattcttatttttaaacttcaacagagagtcagttaccctggtaattcagcaacaacaagcactttgctgtcaaacacctaaatatctctaattcataacttctcagaatgcaacacttgagatgaaaccctccagtcacagccatctatccacctagctttgagactgagcattcacacactttgtgtatcgcctgtgtcggtgctgttcacatggaactttaaaaagttcatcaagaagatttaagcactaataaataaagttttcgccgggtgttggtggcgcacagctttaatcccagcactcggcaggcagaggcaggcggatctctgtgagtttgaggccagcctggtctccagagtgagtgccaggataggctccaaagctacatagagaaaccctgtcttgaaaaaccaaataaataaacaaataaacaaataaataaataaatataaggtttccactaggtagggatgcagtatggagaatcatagatgatggcaatgtctacaatgttttcccaccctcatccccagaatcaatttcttgattgattgccccaatgaagaatatgtgttctgacagcatcaacagtagctctgaggaaggactcccttaactggctccagacagtctcaatttcatcccacagattctctagtatttggaactaactacatcccttcaatcactagtaccctccctcagctctccctacagatctctgtaactggagttcttgtgactcagtccccacgttaggagtcctaatgtggaaggcactgttttggtccccaggcttgtcttaattgctttccaattgctgtgaaaggcaacttataaaagagtttattagggcttacgattccaggggtgagtccatgaccatcatggtagaaagcacggcagcaggtactttaagtgctggagtaatagctgggagcttatacctgatctacaaataggaggaagggggggggcatgaactgggaatggtatgagcttttgaaacctcaaagcacacccctagtgacacacctcctgcaaaaggccacacctcttaatctttcccaaacaatcccaccatctggggaccaggctttcaaatatatgagcctatgggtgtcattctcatcaaactctacaaaatggttatcatttttgcatccctgcaatttgttgttaaaatgaggcacctgcacacgtgtatataatagtctgacacttagtaaagaaaggatctctcttcccctgtttggtaaatgtatctagtgacacagtccaagatagagccctgaaggaggcggcctgactggctttctgaagctaccaagcactgaactgaactcccggagcctttcttcacgtgtccagctctgaggttggacccttcttcctccccagttgttttctgagacccatatgagatttgtagtcacaccattcccacttcattctgccagcctctcactgctcttccaacatgttgagatatttgaaaattccgactctatcatccagtgttgttgttcctttatcttttcttttcttaagaaatcttcatgcgggctggagagatggctcagcgattgagagcactggctgcccttccagagctcctgagttcagttctgtgcaaccacatggtaactcacaactatctgtaatgagatctggtgccctcttctggtgttcaagcatacacgcataagtaagtaaatcttaaaaaagaaaaaaaaagtcttcatgcaagtcagagaagaaagaaaatgtttgaggaaaaggaagtaaaataatcagttcctggtttgggcatatgctgagatgcctgcacaaggaaggcttagtgtgtctaagcttgtcttaaaaggcagcatcatatagtctccgtgtctctccacttcaggcagagaagggatggagataggccctctcaggactaccttcactgaggtttcaaagtaagatgtgcttgacatctgtggtttaatcatacagtatgtgtcagtgtgcattacactgcaaacattgctggaacaatagaatgataaaaaattcaaagcttgctctatttcaggtgcttaactacctgagccatgggctattttgaccacattaacaattaagtggaccaacagcacacttttggaaagaaagattttgcttcaatgctgcatgggttttgggatgagacatctactcaccaatggcaggttaaaagagatgatttcccaaactctaccttaagtgtaccaatgaggggctggagagatggctcagaggttaagagcactggctgttcttccagaggtcctgagttcaattcccagaaaccacatggtggctcacaaccatctataatgagatctggtgccctcttctggtgtgcagatatacatggaagcagaatgttgtgtactaaataaataaaatcttaaaaaaaaaaaaagtgtaccaatgagtttaaatgacaactttcaggagcataggtaatttacaggcagctactccccggaagaagtctccctccagcaatgctaaccatacatttatccacagagagggaggaggcttgctgtggagcattcatttaggatgtgttacatttgtttatgctgtggaacatttgtttaatgattcaaagatgtactgtattcttttaggttgtatttgtttatctgtgaagctgtgttactgtgcctgtctaaaacacctgattggtctaacaaagagctgaatggcaaataaccaggtaggagaaaggataggcgaggctggcaggcagagagaataaataggagaaatctgagaagagaaaattgggaagaaaagaagaaggagaggagcacatcaggggccaaccacccagctacacagccagccctggagtaagaagaaaggtaaataaaatagagaaagataaaatcccagaggcaaaaggtagtcaggataatttaagctaagaaaagctggctagaaataaaccaagctaaggacaggcattcataagtaagaataagcctccctgtatttatttgggagctgggtagaaggccccctaaaaagcaaaaaagagtaagagtaaaaaaacaatcaactctagggcctaacaaactttgtggctttcccttctgtgaggaggtgttagctagcccaatcttatgagaaatcacagctgctttgcttttgagacagccatatcgtgctcggaagacagctccacagcactgctggtgctgtctctgatgagggtcaaaggggagtgtggacttgaattatttagacatctggcctaatccttcattcagtgagaaagacccagctcatgacagttaattcatgctacttggagtccaaaacagttataaagctacttcgaaatgtcctcaactatgcctaagagacctgtttttgacagatgtgctcatgtagtccagtcaatcggcatatggaatttttatgtacaagtgcctgcacaagtttcaccatgtaacttttattagcgctcccactagcatggggagacagatggcatacacattacactcagaagtatgctttgcaattggccttcctggcttgactgctgagtgctcattgtgcatgtgttcacatgcgtgtgtgtgtgtgtgtgtgtgtgtgtgtgtgtgtgtgtgtgtatgtgcgtgtgagagagagagagagagagagagagagacagagacagagacagagagagggagacagaaaagagagagatcaacagacaccagtccacatgtaggtgtgaggtttctaaagtccaatctagcccgcctagtgtccactgtggagccttcccttccctgctgagatctccttccctacttccttgctctttctttgattttccacctctggctttccatctcttgcatctaggccaaggctaggtaggtttagacccacgcaagtgtgtctaacccttgatttgtgagccacatgcagccaaagatagctcccagtgtggcccaacacaaacaggtaggtttacttagagcattgtgacattaggtgtacaattttcctttttatgacttcactgtaaggttcccagtcatgaactttgtagacaacaacaatcctgttgcttctccaaaaggttgcactcacaagcgggagataagcaagggaagaacacttccagaaggtgttctcttcatctctctagctctgtctctctccctgcccctctcctgacagtctgagttagcactgcctttccttgttcttggactgtgctacagtctgaacatagttggtccctccctaacccatgttggagtttaatccccattgtgagatatggagagaatttagctatggtgttaggggttgcccctttgagaggagtgcatagatctggaaggtcagcagatggagcctctcccactgaatattgatggctttgcaagaacaaagagctacatagagaaaccagaaagaatagtcaccagaaggatgggcctagatggtttagaagactaagttgaggaattgagcttcgataaaattattttgaagttaatttggaagaagaaatattcaatggtagtcaaaatatttggaatatatatatatatattctgagacagggtttctctgtgtagccctggctgtcctggaactcactctgtagaccaggttggtctcaaactcagagatccccctgcctctgcctctcaagtgctgggattaaaggcatgagccaccacctccaagaaaaacatttgaaaatcttttttcttttttttttttttggtttttcttaacaaagaaggattgaattaaatctaacaagtgtcaattacagaaattaggtcagattacagaaattaaaccagtgctagatagattaaatggaaaggctatgacttttacaaagaaactaaagtgaatgagaagactgaacgtataataaaggcaacactttacatttgaggaagagatctcattcagtaaatggcattgatcaggcatggaagttcatgcctgtaaccccagggccatagggagaagacagcaggctacctagggcttgctggccagacaatctagccaaaatggtgagccttaaattcagtgagagaccctgcctcaaagaaatgattgaagaaagacattctcctacaggggcacctgcaaacacacctgcacaaaagtcaatatactacacacaaaactcaaaaataagcaagcggattttagaacaactaccacctaactgaaggagaaaattgactttctgtaaagcctagcatggggaggtgtgtctcataatgacgtaagaacaagatcatctctttgaccaaataaaactgaaaactcctgtgttacacaaacaaggaaatcaaaaggcgatttgggacaaagtattggtatttatatgacaacacattctggcaaagaaatccgcctccatcaaaagaaggtaggttgagaaggtgagtggacaattcacaaagaaaaaaatatatatgtattcaaactcaacatcagttaaggagttaattattaattaatgttaataattcattaccgctagttaattaaaacttgacttttgtttttcctatcacaacacaagtactttaacaggatatagtgtacaacattggcaaggatgtagaagaccatggattacgaggcagaggtagataggttgggacagagtccattgctcctgaagctattggacatctgtcagtcttggtcaatccagctggagttcttgacagcataggaagacagacagcaggaaagcaagggagaaagatttgggaagatgctcagaacacacgtagtttctgatgccatgcatctaacatctactttctaattcctcctcattcgtgtttttgatatttattgggtacccaaggatcaactctaagaactcagtgaccattaattctggtttcttttaaaaagcattttcacttttagtgtttagagcaggaaacagtgtagtcatttaaatgagctgaggcatctacttatgtacaatgtgcttggcaaagactcctgctggtggcccaggtcgggaaacaggagtgcatgggtctcagttcactagctatggggttttggaaagttgtttaatagttttcagtttgtttgctatacatttctattactgtaactaggcacaatcacctttagtgtgattgtgaggattaagtaaaaatgtgtacgttaggccccatgacttggtacacacttcttaaaagcaggtttccttccttctagggagaactagctgtgtggtaagttatctcaccctctgtatctccgtatcactgtgtttcccagcaggtcctgggtttcaaaatccaaagccttgataatctctgatgaagggttcttggcaataataataataataattttcatttttaaatgagctgtttcctatttctgtgtgtctccaggctgagagagaagctctggcttctggtggaatactgatgtctaatccagaatggcccctgtccagctccccagctgtgtaggataatgtgttatggctgcataaaaatggaagagtatgtgaccccatctggtgaggaaactgagaacaaaagatgggcaaacaggaaccagcaagacactggtctaaagggctactaaatgctcatggctgtcagaatttggggattacctgtagtcaccacattaaagacaggacaattgggtaaaaagtacacatacagaaaggggcttggtggagacttcactgtcccatctgacactggtaagccacgttaagtcacacagcttctgacacggctgctgctgtgctgcatttccctttaagaggtaaaatagaaaggttacttaaaatgaagagatgcttccgaaattggaggtggaaagtggagatcactgctgcccaacttcaatcttcctggcaggtgcattagaagtacctgcggagtttgttaaatacagagaccagagcctgatgccttttgcccatgtgggtcactgtgacaaagtactatgggcaggctggcttatcaacagcaggaatctccaaagttctgaagtcagggcaccagcatctgggttctggtgaggacttcagattgctatcctctcactgtattcccatgtggtgggaaggggtctagagggctccctggaggagtccctttttaaagggcactgctcccattcatgagtgcttcccccttattatctaatcatgcccctgtgttccaccttctaatcttgttacatttacactagatgtcttcctttttaaaaatacttttattatcagctgggcattggtggctcacgcctttaatcccagtactcgagaggcagagacagacggatctcttgtgagttcgaggccagcctgatctacagagcgagttccaggtcagcctccaaagcaattcagagaaaccctgtctcgaaaaacaaaaaaaacaaaaacaaacaaacaaacaaaaaacaacaaaaaaaccaaccaaacaaaaaacttttattatcatttatttatatgtatgtgcatatgtctgcatatgaggaggccagaggggtgtcagatcccctggagctggagttacggttctaagctgcctgatatggatgctgggaatcaaacttgggtcctgggcaagagcagtatgggctcttaaccactaagccgtttctcctgcatccactaggatttcaacatgtgaatttggggatggcacgcagccagcctgttgtccaggagcaggaccagagactttcagaaaaactccttggtgctgcggtgcagggctgggacagccaagagtgctatcttgtgtaatttccagatggctggggaacgaagcctgaagactgattagttctcaagagtatgcagaccaggtttctttagttttcagaacatgaaagtaattatcccaatctctcttgtcttagctaaggctggagcagacacaacttactataataggggtgcagataacagtactgtatactggtgaaacattagggaaatctaggaaacaggaaggaaggaaacccaggctttacactccatattcttttgtgatgatgatgatgatggtgtgtgtgtgtgtgtgtgtgtgtgtgtgtgtgtatgcatagtgtaggggagcatgtgccattgtagtcatgtcagggtatgagtgtagaggtcagaggataaatttattgagtcagttctctccttcctcttttccggggctctgtggttggatcccagtctgctaggattatgtaacaatagccttttcacacagagccttctcacctgctctttgcccagatgttctgaggtaattggtttggggtggtctgggaacaagattaagttttcaaagcccagtaacttgctaccagagttgagaacggcttcattagctcattattgtcaattttggctacacataggaagcacttggagagctttttgtttgtttgtttgttttgtttttgggttttttgtttgtttgtttgtttgtttgtttgtttgagacagggtttctctgtattgttttggagcctgtccttgaccaggctggctttgaactcacagagatccatctgcctctgcctcccgagtgctgggactaaaggcatgcacccccaatgcctggccctgttagaaagcttttaaaaaaggatgctgtcttagggtttctattgctctgaagagacaccatgacagcaactctcataaaggaaaacatttaattggggcttgcttacacttcagaggtttagtccattatttagtttattagaagcgtggtggctgcaggcagacatggtgctggagagatagttgagagctctacatctggatccctaggcagcaggcagagagagaggccctgggcctggctttggcatttgaaatcccaaagcccacctccagttacaacctttctccaacaagactacacctcctaatgttacccactcagcactcatacaggagtctctgggggtcattcttattcaaatatccacagatgctctgatcccaccccagagttcaatttaatcataatgggatacagcttggacatccagagttaagtatccatggtgattttgatatgtctagtatataaacaaatttgagaacaattgttgaggccagagaagtagctaggttcccctcttaattatctaccccaaattccctgggctagcatcagtatcaccgagaaatctttaagaaaagcagttctctgcttgtggtggtggtgctcacctttaatcccagcactcgggaggcagagacagctggaactctgagttcgaggatagcctagttacagagggagttccaggacagcagagctacacagagaaaccctgtcttgaacacccccttaccctccccccaaaaaaagaagaaatgcagttctctggatgcacacaagatccagtgcagcagcacacaccctgggctatccaaggcctccagagcccctgatctccctgtggttagtagtagatttcacttcccacagttgttcatggtccagcttgtctcctcccagagcctagccagttcaagaatcaagaaccacaggcccctggacattggacaatgtcaaatctcccagatgaggggccaactttcttagtgtgtctgaattttttttaattagttcaaattagaaacaagcttgtttcacatgtcaaccccttctccttctccctcttccttccctcccttcagcccccacccccagtctcccacctcatccccctctgcttcccagggagggtaaggccctccatgggggtttctcaaagtccgtatcatcctggggagggcctaggccctccccatgtgtccaggctgagcgagcatccctccgtgtgggatgggctctcaaagtcccttcttactccaggaataaatactgatccactaccaggggccccatagaatgccgaggcctcctcattgacatccacttcaggggtctggatcagtcccgtgctggcctcccagacatcagtctggggtccatgtgtctgaaattttatataacccgagaagatattttgttgtctggaaactgctggtgtcaaactggacgagtctgctaggggatagcagctgcatttctgctcaacaaaaccaaatgaggaagggagggcaaaggcaggggaggcaccactcagagcaaacactgtccttggctgtctaggatgtaaaactaacatgaagtatggggagaacggagcaaaggcacgtgtacacagctgcagaggccagagagggtgttgtttggggtgggtttttggatatgggtgccttcagttttgtcacacagatcaaacgcatctttccaagaaaatcctgtttgttgtttttgagaccaaatctcactctagctcagactatcctccaatttctagcaatcctactgcttcagcctccctagtgtttggattgtagatcttagtcaccaacctagtccaggactgcgtgatgtaaaataataatagtaattgcagaggtgtgtgtgtgtgtgtgtgtgtgtgtgtgtgtgtgtgtgtgtgtgtggatgtcagagtaaaaccctagcatatgggtcctggggatgtcagggttagcagcaaatgtctttcccctttgagccatctccccggctttcttgataagaaaacaaacacaagtgtgtactgtattaaaccctggaagaaaatctgcatggacactttaaggctcaacagagtagaaaaacacacattggtggtatcaagtcacttacacaaaaaaagacccgcaggaccgttcactttcatatatgtagtttattttaatttagtccagcccttgctgaggatgcccaaggtgtagatggcattgaacttgatgtcaagtaggtcactttctagcagggagagaggtgagcaagtgtatttctgttctatgtgctgatttccttgtaagcagattccaggagagttacagagggtgagggtgatgtcatcagtggaggctggccctgggcctggttttgcagaggaaggaaaggcgttttgcatttgcatcaatccatttcctgttgctgtaacagaatacatggaacaggtaagcagtaaagaagtttgttggactggagagatgacttagtggttaagagcattggctgttctagaggacctgggctcaactcccagtacccacatggtagctcacagctgtctttaactctagttccaggggatccgatacctcatgcacataaaataaagttaaacaatttttaaaaagaagtgtatttagtccagttttcacagaaagccagaagtttgtcaccacggttcatgatagaagagcagaggtgaaggtggcagggacgaatcaggctggccttgttctgtgacaacccctcttgggagaaaggcattaagctgtctgtgagggcagcatccccatgacctaattacccttcaaaagccatgccacagctgagtgctgccacactggggactcattttctattgatctggaaggagacaagcctacacagaaaccatagcactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacactgtgggcttctggctgctcagtggtgctaatggggtaatcatggagctggaagcagcaatctctgtaatgagattacagagttggtggagatgaggggcccttctatatgcagctaagcaacttgaactttagcatacttatctgtcatggccaaacctagggatcgccaaaattagctgctggcatctctaaaataataaagcaatatcaagtcccaggactcatcttagaagcactaattcagtggtttgtggtggtccagagggggaaaggaaaatagaacagaggccaggaaaatctaagtaattcagctggtcccctgaagcagctagagcttagtgcaatggactatgggatggctaggtccctccatttcaacattaaaaactcatttaagctttatttagagaaggcaaatgagggtggcccttgggcagactatcggtggttcatgttggaggtggtttgctgatatacattggactgtgagagttaccaatgccttctggggtttgattgggactccacccatgtgtaaagttcatcttgtgctgtaacattcatcccaagtagtgacaagattggaaacaaatgaagtctggtcatacttactgctatactaagtacttgtatgggttgctcttagaatttgctaatgataaatgtttaaaatgtactttgtacagaaaactaacaggcagagatttgtctgagtgaagacaagattggtcaaggctggatggcagtcactaatagtggatgtctactacaaataagcaaatcagcaaaggggtataaagtagaccaaatccttgagccagaaaaaataattctcaggaagttctgctaggaagcgctggcgttagacacatggcctttcattgccttgggaaggagtcaaccatagattttctgtctgtcttgcttgggaccatatagttggtatttgagctcttggcccacatcaaacataggaaacctataaaagctgggttttctccaaagtatatgttttatgttgagagctgagagatatgaaatgaataatataagctatcatagagtctcatcactcaactttttatgtcatgatgttgaagactgttttccaaaactgtcagtaaaatgtctcccacaagcggtttttacctcattcttttgatactcctcctcttgagagttaggtctcctttacaggttaaatcatgttttccaggaatttctatgtggaagcagtaactcacagtacttcggtgtgtgatcttagtaggaaaataggatcatttttgtttgtttttgtacacagggtttctcttcacagccctggctgtcctggaactcactctggccagtctcaccagactggcctcaaactctcagagatccacctgcttctgcctccaaagtactgggattagaggcgtgcgccatcacacctggctggaggagaggatcttaaagaggatttttatggaggtaatgcagttggagagtcctgataaatagtggaggcttgaacacagacaaaaacagagggaagatgatgttcccagacacagagaggaaacaatcacttatgaaccaaggagaggggcctgaaacagaagcttccctcacaccccaggaggagccagctctgcctatgccagttcctgagacatcacatttctgttgtttagcttcctagtttgtgttagtttttacaacagccctaactctcctacagttctggaattctttgaaaattgtggaagtgacactgtgtgtcttcctgggctaggccataaaaggcaacagagctaccacggattgtattgagagaccaggcttccaggaagctcaagccacttgcaaaggtcacattttggtgccctgccagcatcccaggggattggaagaatcaactgctagagctgtgaaccaagacagctacagatgattcctgctcctgtgtgggtcagcttagcctgacctgaacctgcctacggtctaattagttattaaaaagataagagacagttttgagtctttaaagtgtgctcatttttaaagtagtgttcttatttttgtaggattacttttattgcagttctactgatcatatgaggctggagagctagcccagtgtttaagagtctgttgctctcacagagcactcatattgggtagctcacaactgtctgtcactccagctttcggggatctgacacctcttttgacttctacaggcactcacatgcatgtgtgcctatgtggtgcatgcacacacatgaataaaaattaaaaacataaaagtctattttataactatttcaataaaaacactactgatcataacttctcctttataaattctgtgtagcaaagccttttcttattgttcttgatgaatttttccattctctgaaaagtaaagatcttctatattccaagatttagtaagtagttcctttggtatttgaatgcagagtgtcccccatagctttgggcatttggacacttgatccccagttaatggcactgttcagggaggtttaggtggtaaggccttgctggaggaagtatatcagagggggtgggtttgagaattaaaaagccccatctgtttcatttgctctcaccaattaacagttggccactcaagacttgagctcttggcttcctgttcctgccaccatgcctgaggcttgttgccatacttgcaggacaccatcatggactcttatctttctggagccaaaataaattctcttggtcttagaattttaccataacagaaaggtcaccagtgtagctcctatatattttttcattataaagggctgtatcattgaatatatactttcaactaaagtattgcagccagacatgaaaagaggaaaaggttctcaaattttaaaaattcttcccgtggtagtttgagtaagactgtcccccatagatatatttatttgaatgcttggtccaaagttggtggaactttttgggaagtattaggaggtgtggccttgttgaaggcgtgtctctggagatgggccattggtattttgccatgggtattgggtcttgtgggatatttgttttgtacactgtgtgaggatatattgctgtgattggtgtaataaaaagctgaacagccaatagctaggcaggaggtataagcgggatttctggggaaagaaagaaagaggaggagaaatctaggcatgcaggagaagcaaggagaagaaacaggaggtacaagataggagagaggtaacaccacacaataaaacatagattaatacaaatgtgttaatttaagagctagttaggatcaagctggaactgtaggctaagctttcataattactaaggcggccttctgttattatttggaaactggcaggacagaaaaaaaactcattacagattcccctggaactggagttacagatagttgtgagctgccatgtgggtgctgggaatcgaacccgggtcctctggaagggcaatcagtgttcttatccagtgagccacctctccagctgcccccatcacttctaaaggatcattagtttagtacatctgggatttattttggcatatgggctaaacatttcatttttgtacctcataaaagcagatcaactgttctgtaccagctgctgaataattcctaacttttgttctaatctgtgagccactatgaagtcatacactgagttgtccatcatcacaaagcaaggcccatttctggactttacagtttgcacttgactttagttttagatggggcttcccataatatctgataaaggagttccacactctgtcattctttttggaaactttcatagttgtcctcacacacttattttccacacaaacattgaatacagctttttaagctatcataattgctattccaatagcataaactcaggaatgtagctaagaaatatctatgcctgttaatagttatcattgttgtttgcaagtgtcattcatatatctgtgtttgtttcataccagcaaagccttagacgcagcatgccaggaaatatactcacttcataatcctttattaattgttggtggatacagagatggttaatatatatctttcacaaacaggtcacctttattctgcatcaaaacatcattgggaattagatgcagataaaagcgagagtaattttaaaggcacacagtttggtaagttctgtgtatgcacccatgacattctcatgggtcctggtgataaacatacccctcagtcccaaatttcccacgtgtccccatacattctagcattccattctcctgtactaccatttccaggcaactggtaacctactttcactctagtttgctttttctggaaatttaacatggattttttaaaaatagaatgtactgtcttgtttaattttctcttgctgtgaagagataccatgagcaaagtaatttatagaagagtttatggatggggacttacggtttattgggattagagtccatgatcaccatgctgggaagcatggcagcagccaggcaggcatggcactggagcagtagctgagagcttgcatcttaagttcaaataggaggcacacagagaatcaggaatgtcatgggcttttgaaatctcaaagccaaccccccagagacacacctcctccagcaaagccacacctcctattcattccaagggtcttagcccaaccacagaaggctgagctgggtcccaggaagggtaagtgctgctcacccattccccagcctcccaggatactggagtcaatcagacacagcagggagtctagtcaagcaggaactcatttattgctccacagcaagcatcttttaaagcaaaacaaacacagagtgggaaaacagctagccaatggttttaaaggtcagcctatcagctgcctagacatcctatgctttacctagtgaacatgagcagttcacacagtgacctcatttggtttgatcttggtaaccaatcaccgttttttgtaaacatctcaggattcactctcctgacttcccctcatcaccatgtttaactggctcttgtgcccttcaccttcccaaacagttttaccaaatggatccaagcattcaaatatatgagcctgtaggggtcattattattcaaaccaacacattctactccctgcccccccataggcttgtagccatatcataatgcaaaatatacttaggacaattcaaaagtccccataggctttcacagtctcaacactgtttcacagtccagttttttctgagactcaaagaaatctcccaattgtaaacccctgtaaaagcaaaaatcacactgcatacttccatatacattagcattttagaaagagcatacatagcataaaagaaagaaaaggggcatagtgaggaaatactggacttctccttccctgatatacatcattaatttaatctttgcttttaaaagctgggaacagtaccctttcctccaccccttatacctttactttgtcacaattattatctttaacaaattatatcattcatgtcatttatttcttctagtgtcctgagaagactcccactttttttctgatgtatcccaagtgtccagaacctgcctcgaggtacacaatacatctgttgagtgaatgggaagacccttccctctagcaaacaccaagtcatttaactgcatcatgttgctagctccagatcagtttctcaagctagcaaagaaacatttgaaaatgttacgttgtattggttcctctctggaagggtcacaacacgttaacaaatccagcagctccaaaggctgcagtcacccctgctttctccatttacttaagacttcccagcttttcctggccaaggaacattgaatacacaacagtgtggtacagttcttaccagtattgcatgacacctggggatattttctattccattctactcttttttatgtattctatttttcctgtcccattcagttctctttcaatattgaccaaacccaatatttcatgaggtgggattttgtccatgactgttgttttggggagagtccttcagactaccatcaaactcaacccatctattatggtacttatcccattgtttccaatttagttcctttaaaaaaaaatcagtgcaattaaccttcaagaatccagttgctaatcattctggtaatttatgacaaaattctagaataaatggttcaaaggaaatagatgctaagatccaacctctgcattgctaaattattttctaaaaggtttgcacccctgtctacctacacagacaaatggaattcctccaacatactcatcttcctatgtaaagttctacttgctagagttttcttttccccctatttttcatgattctaatatttgttctgactttttttgtaaattttgcatccaggtctttttccagctcttttctgctctggaagagagccagctaaggggctctgtatacttgtagtggaaggtattgtgatcctttctgaggacagttcatgtttgtacttgactgcaaccaacagcctctagctttgtgagggaacatagaataaagtgaagtgctgtctggagggtaaacagagggtatagagaggctagaagatgggttgtttattttctctttttttttgaattttttatttgaattagaaacaagattgtcttacatgacaatcccagttccctctccctcccatcctcccctaccacccccctccccaactaaaaccctacctatcatatatcctttctgcttgaagatgggctttttaaaaatcatctattgatctatatatcatatctatctaccatctatcaatctatcatatgtatcatctatctctatctctcatctatctctatcgtctatcatttatctatcatctatctttgtctatcatctatatatcatttatctatcaatatatcatctacctacctatctatatctaattttatgaaaggctttattatgacctcataagcatccttttcactttcagtatgtcttgtagacaaatgaaactcctaaatcactttaaaaagccttgcctttcctaaggagaacaatttctcttcacagcccctgggtgaactatacatggaaaataaataaatccactctttctagacatagtacaggccgagtattctaaatccagaaatacaaagtctgaaatgctcaaacatctgaaccacattgaaccactcacttgccacagcaatggaaaattccacacctgacctcttgtggcaggtcacagtcaaaacacaagcaaatcagaaatactgtgtgagtccaccttccagctgcataggtgcatgtgaaatacagatgggttttgtgtttaagctggctcctagcctcaagatgttttctctaacatatgtaaatattctaaaatgtgaaaaatagaaatattaaaaacttctggtcccaaggagttttaagaaaaaagttactcagcctgcaacctaaaaaaattatttgttattattatgtgtgcatacacatgttcaggtgccctgaggtcagaggacaactatataaagccaacctgtaatctaatctctcaattctttctatgtaagaactaaatatactcagtctgcttccaggaaactgagataccacatcagaacagagctgcagctctgttttctagagggggttgtcttaaaagcagccctcagactttggagctatgctcatgatgaaaatagcatgtgatcgccagaaaaagggttcagtgggtaaaggcacctgcaccgagactgaagacctgagttcattccccaagacctacaaaatgaaaggaaagaagtgactactgaaagttgtcttctgaccttcacatggaagccattgcatgcccatgccctcacaatgcacatatgtctgcaaataaaatgcactaaaactatttttaataataaaataagtaacacttgaacatctgagttaggggcacaaaatgcaaatgtgtgtcacttggaaccaccaagcatgcctgagtggtgcccttaggagctagggctagtccgacttaattgtggtagtgaaaattcctgactcagtgtaaataatttcactgttataaaacagatttagacctttgttgatatcttgggttcctgaggatttctgagtctggctcatgctagtttaaaaagctcttatgcaagcaagacctagcgggtgaggtctggaggctactaagacagtctttgcaaagaaagctcaccttcctccagcacaccaaaaagacccaccattagaaaccagtgtagaacattgtgtccgtggaattttccaggttaaaattcacctgtgcacgggtgatacctaccacttcaccagtggaacttggccttgccttgaacatattttcagattctttgcagccctgaagaaacagttgggggtgggtctggcattcctgttaccgagagctagcagttcccagacaccatttgctcagtcatcacagggaggttgccatggcttggaattagcttagtgttaagtgttacattgtaacactattacactgtagagaatgaggaagagggatgtcagaagctgtgttctctcaggtacaaacctcgaagggctgggctgctcggatggatggctctggctgcaaccccaggaatacagcttccaacagagggaggccacagatgaccaggaagaaaagttagggtcatctgatcccctgagaaatagagcaggcaagaaggtgtaaaatgggatgtagtgaggatgttctcagatttcctgaaaaagaatctggagggattgtaaacgtatcttttactgaagatgcttcaaagagtctaagcctccaggtctcaaaactgaaagctgagctttcagatccgcaaaggtgagtattcaggagtatataaagtagaaaccagcttcttgcactgtcagcacagtggggttcctttgagaatttcaggaatggaggatgcgagggaatgcatatgtcacaatgtttactggatgtctgtgacatgaagagtgctacaaaaagcagagggaaggttagagacatggacagagaaataggaaacaactctaatagccatcacagatgaactaataaacagcataggaagtatatgtgcacagtagattaccaatctgcctttaaaaagtcctcatctatgctaccacatctctcatggatgaacctcaaagaaattaagctgaacgcagtaagtcagacacaaaagatgatcatgtataatctcacttatgtgatatatctggaatatccaaatccacacagaaagtaacagtggttgtcaagggctagtgcctgtacctgtgcgtgtgaagtgtgaatgtgtgtgtgtgtgtgtgtgtgcgtgcgtgcgtgcgtgcgtgcgtgtgtgtgtgtgtaagtgtgtgcgtgcactcacgtgcatgcgggtgagtagggggaatggagagttattttttcatgggcacatatttaagtttgccacgatgaaaacattctgaaagtggtttggggtaatggttgcttagcaacacaaactctaatgcccctggaacagtactttgaaaacaggacagtaaactcttcgtgtatttcaaccctcctcaagaccacaacaagcaaataacaaatgagagggcccaagatttgacatcagaaatagaggaatgaagatcatgcagccacaggaagggcagtccaagatgagaaaccggggtgcactgcagcaggctcaggtgctcctccatcacgtttggctaccagaaggagaaagccttccatttaggaatagtggtttcttattacttggctacttaggcacaaagcagtacctttgttgtgttttgaggcaggaggcagggtttctctgtgcagacctggctgtcctggtgtcatgtagcccattgagtaggcctcaaaatcataaagacttgcctgactccacctccccagtgctgggattaaaggccaccataaccaaagcactaacttaatgcttgactacagaatgactcttggaaggagggacactgccccagaggtcccagagtttaagaaatgatcacattctggttcagagacaaaccaaggagtcttttgtttgtctttgggtttctgttgctgtcataaaacatgagacaagaccaaaagcaacttaggaaagagagggtttatttctgcgtagagttccacatctcagtctatccttgaagcaagtcaggggaggaattcaaggcaggaaaccagggcaggaactgaagcagaagccatggaggagtgctgcttactggcttgctcctcatggcttgcttagcctgattgcttatggcacccaggacctccagcccaggtgtggcaccacccacagagggctgtgccctcccatatcagtcagtgaggaaaacacagtacaggctgtgtctacaggccaatctggtaggggcattttctcagttgaggtcccctctgccaaaatgactctagcttgcgtcaagttgacataaaactagccagcacatattgattcttaccttctgagtttacatagccaagtttcacctcaaaagaatcttccaggcctgtgtcaaaggcaaagagttgaggcagggcctccttcctgaaggtggtgccaaatttgttacctcagctctagggttcaggccatggacccaaacagcctgtagcgatgaaactgataaacctaaagcccaaggaaacaactgtgtgcgggcgcagtccctgcccctcagaggatagtttgagaaagactcatagatctgaggcctgattcactctgcaccttctgctcccaggatttctggccaccaaggtggcctcaggtgcccaggccaacccgagggacagctgggctccacaccgccgccagggggcagctccgccgcgctcccacatagccagcaactttcttggtacctgcgtatggtggaggggggagtcacagttgataccgagtgacagtcctgcctgcctctggtaaaaatttctgccccacccccagtactagcttgaggggggatgagatagagatttaccagtcctggaaaaagccagggctccaggagacccagagctggggaacagggaggcagaaagaggatgcgcgagcacggattgggtttccatgctgggaaatcgcaggacgagaaacagctaagggactcagagtaacaggtactttaactaaagcaaacaaaacaggtggagcgcccaaaggtggagctttggtgaagcttacccaaatctctgttaacgtatttcgtatttcgtccctacagcgatcctagtgggttgaggctctctgacaaatccccacgttttcccgagtggcctgaaagtccagggaatagccccttaattaaacttttggggacagacttgggggcgattttacaaacagaacgcaaactctcatttcccatacccttccagaacagacaagttgaagacgctgcaaatcttgagtagaaagatggctgtaattgatcctctaacgttattaatagcttgcgaacaattcttcctgtatttcatcgtcaaatgcattgccacacagcaacactcagcgctgcgaaaaccatggtgtttatttggatatccgccgagtactcacacaacttaaacgttcgatgtaaaagtggacatcttggtaaggactcttgtctgcatcaacaaagcactcgctgcctgattaacggtgttgattaatgttggcgcaggttattacaataattagatggtccagccatacatcaaacggagaggcaatgaaaaataacgcgttcagaccatgaggcattctcgtagctctttcaaagatcactaatagactttacgggccatttacaagtggaactggtggttagccattggagggaaccaaacctgatttgaaaagaagtcttggatggggcaagagttcattttttagactctgtgatgaataccagttggaacaagtcgtttcagaaagtaggaaagtacttggttgataaaatgacatacaaaagagtccttgagattgttcctcaagatagccattgaatttttactcagttcttggcaaatgacctttttaaccagaaagttaaaacttctaaggcagcgtttcccctttgaaatagaacatctcagcaaatgcaaacatttagaaagccaggctatgagaatgaattcgagttacacaattattcggatgttccaccagtcaaaacaattagtttagctggtgatgagcacgggtatccttaaaacagaattatacttgcattattcctattagcttgtcacctggaagaaaaatgaactgagtggagttgattcccatatttatgttaaaaaattcgtttcttttctctaagagggtaaaaaaatttaatgtattttccaaaacaatataaaaagttgacctcaaagtaatctttgctttgtcttttccagcaccgatcctgcctgagcagcattgtgtatatgttataataattccagtatagagagttccatgaaaccccaccagagcagatcttttactgaaaaacatagcgcccctttttctaacatggcaacagttttttgatgctcttagatacaatctctctctctctccctctctctctctctctctctctctctctctctctctctctctgtgtgtgtgtgtgtgtgtgtgtgtgtgtttgagttttcactaaaattttctatttcttttcctcattcaaccattgctctattcccatggaatttgcgagatcctctcattagagtggcttagtttagctgtcaagtctctagggcattcaattgcagataaatgactaaaacgccagcctaaccgcatttttattaacagatggcggaaaacaaacgtctttggagaagaaccgaaggaaaagggttaaagggtcaataaacaattattaccgtgcttaaaacgggggagatttctcatcagattccacaggcagaggctggcccagtccaggggagctgggacaccccaccagactcccccgctcagtattccagggaccaccacacacagagtaagttgtcccacagcgcttctgatgttagggttgaggactaaatccggagaagctggctggggactcgaactcgtgcaaccttcggatgcgaattggtgctggctagggcgtgatacaagatatccgagaccttggcaagaaatagcaatagcggggtccagtgtccaactcttgctgccacccctcctgcgggtgaactttctctccctgtacgttgattcccttgcctttctttcccttccccaggccgcgctctgacgtgcacaccatgtgacaggcccccttctgctataagctcagacaaggtccgccctcttctggactcagccctggcctcgccgagctcggttcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttactgctaggatttccaattgttagaaacgccgttagcgcgcgtgaaaaagcgaaggtaggactcccggctcttttctgcggatgggtggttggttttgttcgcccctcccggccctcggcgacctcgcgcgcccattttcgccgcttcggattcttggaccggactgtgttgggcaccagctggggcacagcgctattgctattggaggtccctctatttatgcaaactcgccctgtgctgcaacccagacttggggtgggaaggaaggggttgttaggagaatcgccctgttttggcactagggcttcttcgacttttgacaaattgagaaaaacaaaacaaaacaaaacaaaacaaccaaaaccatcaatactaagcctttttgaggtatagagattctcaggtccaggagtttttttttttttttaagtcaataatgtttatataaagctcatacaaaaccagtaaagggctccaaaaatgcctttatttgctcacactagtttggcgtactttttcatggaaaggaaaaaaattgattaacgtgtttacacaagaaacaagtcaaaatttattatttcttattttaacctgtgttttgtatcataatggacatgcggaatttttattttgtacttactgcatattctttacaaggagtattgtaaattttactggcgattattattgtactattctaatgtaagatttttacacttttttcagaaataaaattcttaattttcaaagaaaagctaactaagtaattggctgaattgtccttgtcttagttttttttttttctgctaaggaaaaaaaaacttatagattataagtccaaactcagaacaaaatctacttaaatattacttccaaagaaagcttaacataaccacgatggcacaatgtcataaattttgtttaaactttccaaatcagaaccatggcatatcagaacttatttttcagtgactgcaaatgaaagtattactttgctagatgtttccaaggttaagccttctccatcttaaagatcaatgagacatttttaaagttgaagttgcagtcaccctaaggtgatttaataggaatgtatgatttaatttttaaactctccagttaatttctgcttactttccagcacaatgatgcacacaaaatatgctcaaacgtggtgttaaactgtaatgaaagtaacacaggcagaggccgtttctagtttaaaattttaacagcaaaaagagatgcgtagattatctatttaaagtgttcaaagtcccagataagcaaatatttgcacttacaacatgaattgtatgtgaaagttctagcatttaagataaaagtgagtccaggaatcgcacaaatgagttttgaatccaaaggcaaatgtactgaaattttagctgacatgaataacctaagactaagaaaacttgtcatctttagcagagtatatagttcaaaagatttaaaggtgagagctccttgggtgtttattgaactaaataagcaatttggggtatcccttttcaaagtttaagtctttccttgctgattacatccagcatctaattccttgggggaagccaaggctaatcttgactactgtgagccctgcttttagctgatacatctgtaacatgtaatttgaatgcttcttcgggtgagcaggttgcagtggacactgaatctgtttattcagtttctttaaaatgtgggtaagtgtacacactatggtatctcaagacccacagatttaacctgtccagtttatgacgcgtgctaatattataggctagtactgtgttgtgctggtcacacttaatgacttgtctctcagaggcatctgaggaaggaaaagactcaaatacccaagatgaaagttccgtttttgtttttgttttctctctaagagatgtgcgaaggaaagcaaagaagttagagtaaaaacattcacagtgaaacgtatcactaaatatataactaattgttaatgaagatctcacatggaaagtcttctggtactctagtatagctttagaagaaagcagacctcgcgtcccagaccttctgcatcctgagagtccctttacagggcattcacaggcaggacccaaaggcacacacagatgcagcggttcgcctgtagacttgatcacgcacagaatggactttttagatttgaaagttattgcagaagatagcccaaaccaaaaccgtgtgattttgtttttctttcaggatgagtgtgtagatgctccgaaagcagggaatcacagctacgtcttttcttaagctttaaaaatgccaagaggagctctgcctccctggctgtcagtgcacaagcctcgggggcaaccctgtcctggccctgtcgtccctgggctaggttcccacgtcaccatctagggcagcagactgcaaacttgcttttgatcaggcagagtgcagtgagggcctcctgcttgtctgttgcatcccgccaggttcggtgtcctttccgagatttgggggtgtgtggtgggctttacttacttaggagacctgcaggggacagtaagaggctttaaggtgtagcctcacagtggtgcggggcagaggctaggtataggccgagaactggaccgtgggccttggacgggtgagccaggagtgtggggcgccaggctgtgctggcaagcaggtgctggaacaaaggaagccgggctacccaggcctttgatgggcaaggatgtctcctcctggggctcctcattcgcatgcaaatccagcgctggtccccttttctttgaaggcaaacagaaggatgtttgtgtgtttgtaggcaagaaggcttctcgaacaagccttcctcaataggctgggtctcgaaaaataaaccagttggacaaacattggccaccagctctcctcctcccgactacaaagtgtggatttgctacaactcattaacccgacgcctttctctccttttccttgtttctttactcatcaaacgcccccgtagagcctggagacaaatgaccgaagcgcagtcgggagggaattgcagttaatggggagagggatatattggggctaatggttcaggcagctcccgaggaaggaccacacaaaaaggagcctctccattcaaggctctgttgtgctgcggggatttaatctgcagctagatttagccaaatgttatctattgcgggggtaatgaagcccttatgggttgaattgctccttgtaccacacatggtgtcatgacctcagactgcttcttggttgatttctttctctatcgggtaattattttatttcttttaaataaaaagctagtgcttctgctggacaacgggtttcctctccattcccaccccacacatttaagaggcacttgctttcctattttaagaaagaaagaaagaaagagagaaagaaaggaagaaacaagtaaccgaggaagtgaaggggaggctgtgggggagctttccccatcttttacttactgaagcatctttatatgcacccatctctgcttctctgttctctacccagcaaactctcttgtgtccaaactttctgcagacttgagctggaattcgggatgtgcatcccactcccaagttcttacagtgagcgtgaacctcaggaaaaggcttctatcccttgaagattttctttttcataaacccccatgttttcctgtagcctgctgactgggagaactggggcagtgctcattctgatggaaggtgattattttgatggaataccggcccctgtcgtttattaaaggctgtctgaggccactggttgaggctgtgcctgttttgtttttctctctctgaccctgatgactctgctttctttgcttgagggaggaccaagcctagagcagctaaaggtgtttttacaacccgctgctgatgggtaaggatctgaccctactacccacagctaagaatcaaggaccctagatcatgatatttaaattctctgctagccatacattctgttcaccagagcaaagtcacacgggggcaactaaaagggatgttatcactgtcgaactcaacccaaaatcagaaattttcccaggttctcatttggcttcttcagggggacttccctgtgcatttagttggaataccaagagttcccacacacccatatacaccccatcccttagaactgaaccagagatggacctagggagcagctttatcctcactcaagtctctgcctggtgcagctgagtcacgcatacacacaggcgtgcatgctcatggcccggcagctgcctctttcccctatgattttgcaattaggcatatgttttttgttggtaaacgtgtttgatgtcatggccagtgaaatgtggtgtgtttatagggccacgaatgtaaatgtgtaaatatgtttagtgtaaaatctagcccttcgactttagcaataaataggctgccaacttggatccccttacatttgacagggagatggagtccctgatcctggccagctgctagggctgccacggcttgtactttcgcaactgaattcacttttggctaatttctttacacatcgcacctctctgatcacatcttgctctcgctgtgaccagcttgggctgcttttcactgctgacccttctggagttctagaagcttccaggtttttccctcaagcttcttaacaacaaaattcctctagtcatcatcaagaaaaacctagaatataacagatgacaactagtgaaccctttccaaggcctttgcctttaggcatgacaggatataggagctgatttggtggttatgtgctgacccctagccattaccgccattactaccaacatcctaactgtaaaaagtgctttgatctagaatgtggaggctggggcagaatttgaggggatctgagctacaaaaccaaggcatgtcaccctatttcaaaaccaaaccacacgaattttgagctactctaacttttaagagtgtaatagagatacaggagagctcagaagtaactgagtaactttccaccctaactgaggacactgggtagctcatcccagatcaagaagctgttttatcagctgggcgttggtggcacacgcctttaatcccagcacttggggggcagaggcaggcggatctctgtgagttcgagaccacctggtcttcaagagctagttccaggatagcctccaaagccacagagaaatcctgcctcaaaacaaaacaaaacaaaaagctgttttatgggtacattaggcttccctttcttattccagccagtactctcagtaaacattagcgccccggcccccagggtttctctgtgtaacagtcctggcaggccttggactcactgagatccctttaaactttaaaggcatgcaccaccatcacccagcaaacattagatttttaaggaaggattttcactaatatttcagaaagaatctcttaaattttaaatttttatttgtttgcaatgctagatgttgagcccagggcctcatgtatgctgggcaagtgcactaccactgagctacaccccccaggcctccagcagtctttttgaaagaagcctgatagattgcactgtgaaatagtcaggaaaagaatcactgtggactctgctttaccaatcagatagcaaagcttaaaagagggtaaataaatgacttgcccaagatcatagctattgtgacttcactactgaaatcccactttatttacaagaccttgttgtcactttttttcttattattattatcattgggatttgttaagtcctataggggtaggaatatgaccagaagtcatagagtaagtgcagttctttcctttttgtatgctccccatactctctcccctatcatttccataggaagcctattgttctagctgtatttaaaatcaacagctaattgtttgagactttctccatgtagttctacatggtactctcctagcatccccctttccattcctcctcctcctcctctcttttttccctggcatcagcaatcccttaaaaaagtatcctgtctgattacatccacaaacaggtcatgttgtactcctctttacctgtatcttccacttctcttgtagattgaaacaaattatcttatgtgcatccatgtttttccatgtaagcatgttgtgcaccacatgcatgccttttgcccatggatgccagaagaaggcattggaccttctgttattgaaccaaaccatcttatgggtgctgggaatcaaacttgggcaacaagtgctataaaccactgagccatctctccagccttttgtaggtttttaaatgtcaaagtttggcaattgagaacatttttctaaactgctaagcagatcgcacaaatgccttaaggctacatcctacatctttttctttttcgagacagagtttctctgtgtaacaaccccgtgtaaagcctggaactggttttgtagaccaggctgacctctaactcatagagatccacttgcctctgcctccccaatgctgggattaaaggcatgagccacttctggccggcaaggctacattctttctgttttgaaaaggaaagagcatgtaaggagtgagactgattcaataattaaatgagaaaacagttctttttttttctttttgagaacatgtgctctcttctttccatacactcttttgaagactttgctctttttgcacagctaagtgtaggtaatgtgctgtagccagtgattttaatccctgcagatttaatctacagcacaggagcctctgtagccgtgatcttatcagtagctcctatctgccttggtgaacttctcccacagttgaagcactggtggatgaattccggactgcctaccagttcacccttgcccactactatccagaaaagggcagctttctcaggcaggggctggggttactgttttgatactccatccagagctagggctgcaactcagtggtagagcacttgctgtgcaggcacaaggcttgataaactatgagctgcagaatacaatcaagaacttatgacagtcttttcaaggaacagtgattaatgcaaaaaaaaaaaaggttctttttaaacaccagaaacaacaaaaataattaatggcacaccttgaaagatagcactgcccccataaaaacagttcacaaacattagcatgcttatttaaatgttttggaaatctgaatatgaaattaggaaatgaggtggaagggtattttctacttttaagaaagatattttcaaagatagggtattttcttgtgtgtagactactactgatgggagatatatagtcttgtaaggcaagtacaagctatgattgtggcttagacccagctgatgtaggcagcagcagcagcaaacagttggagcatgaatatggggtctcagaaccttgcctggatcttactgcaccagagggtgccaggcacacgaattgctcttacttgtaacttcatcagtaaaggattggcaaacaaaaagaggggaggacagagatggattcctacattgcgagttttagcaatacttgtgaaaacagaaaaatattttcagtaataaagggaagtgacagatcacgtgaaaagtctacaaggaaggacttttgtgaggaaaaactacttgattctctatttttcatattttttaatgcagagctttatgtgtgtgaaaatagctacaagattctattgttaaataattgatgacatgcagagagagagaaaatcatcaaccaatctctaaagtctgtagaacgaagacttcatagaaatgaactgttaggtcggtttccactcttgtgtatagcttgcttccttactctttccttatctcttccttcttttccttttctcagaagatggcatgtgacagcaaaatagttatgtggcaatgctctggaaaatatagaagatattaatgtaaacaattatgatctgtggggcttcttcctacaccttattcattcaggcaaaaaaaggggggggggagaaaaaatccccaaactttgggatataactaaatccttgaattgtaaatgtctacatgcttactttcatcccatcttcctatctctctctgaaaccagttattgcttaatcctttctagaagtaatgaagataaaagagatgacgtttccccttacttcagtcagaattgtatttggactgataactttctagcctcttctaaaataaacaaatggataatgttttaaacgcattcttctggcctcttgctgtttcttccctctgctcgctcatccaccgatcatctctaaccctcaagcttggaaaagtaggatcagtttgcactgtttgtggagcacctgctatactgcaaatccctttagatataggaaacaaatgaaagaattcctgacaccaagctgctcattacctaagcacaaacattgagcaggagagaaggcttttttttttttttttttttttttcagggaacagtggggcagagggaaggctgggcaggtaattcttttattttccattagaacacttctttttattactagaaatttctatagtacataaatgacatgatgatgttgtcttgatgataatatctttggcacatagccactttactcacagtatcaaactccttcatccagagagctgggcatctgagtttcctccgttttggaaggcttcttctgaagttcccagttctctgagaataaatgaaaggacggctgttatcaggctccctgtactgtgaaccaagactgtgacctgcacaaattgaggttacatccacacgggtctccgaagaattatgcacggagacagttgtgaaacccaagagcacatttcccccttcccacttttgaacattttattacagataaaaagaaattttaaaacaaagtaaagtattttcttacgttattttaataacttttcaaataaaaagaaaccccacttgagaaatttcaatattcaatttgcaaacactgtcagagagttcgggttttgatccgctgagggtgcacagcccgccaagaatttcccccccttttcttttgaaatacaattcaaacatttacctcacctttaaagttgtcatcgctgaggagcttggtccaagtcatccagtttggattttgtcttcttctccaaaagcaaccaggaggacacagggtaaagcaccacggaggactcggtgctgtgtttgtctatttcaggaatttaataatttgccttcctcctctttccctggacccccctccagctgcacacatagcagggctccagaaaaaccagctcccacacagctttagaattatgtgagatgggaccccttattctggggagctggtgggtgagggtcgttattgtaactctattctgtaactaaagctctggcgtgtaataaatctctccccaaagacttttggatctttgatttgaaaaatcggattcctttagtggaaacacttgacaggaacctaaaaggattagttgcattccgtacaggataatttttactggcaacattttgaaacgatttgattcctttcagaccttaaacaatgtccagaaaaatgatctaacgagaatcgtattgttttcctttgtatgtcaatctgtctgcccctcccgccaacatctccttggggttttttgagggccctgctcccgagccgtgcaccgaattacttctcggatcgttctttctatcaggttatcttttcctgccaggggacggtttgcgcctcctgggcctaccccgggacagagggacctcactcctagctccgcaagggctgctgcaggctgtgcaaaggcctggcaggaggtcgccagcagcttggcggtccccagtccttatggcccaacattcctcgcagcggaaagcagagagggatgggtgaggacaagcaagagcaaggaatttgcggctctctttcgccccgcggctcagcggagccctgagggcgagcagcctcctagcgcacagcgcacggctcctcccggctggctctcggctgtttattcggttgtcagcggactttggagatgtttttggctagaggttctgacccgcccgggcgctgtggccgctcggctcggactctcccggctgtttttacacctgcacagactcccccgcactcctcggcctgatttattgcctaattaaaggttcagtgctctgcgcgccacccgggctcccttcccgccnnnnnnnnnnnnnnnnnnnnnnnnnnnnnnntggacctctcccgcagggcccctcgaggatgcgggctgggacgcgacggccgtggccccgagacgccgagctcccatagcggaccatggctgtgggcgggaggcacgggggtcacagaccgcccagcccgcggcccagcctaggctccaacctcctccttggcggccttttctttccggagagaataaacgtcaagccagcggagattggcagcattgagcatcttcctaaaccagctctgtcttctttccatctatcaatccacctttctaattagactaattaggagcgctttgcagtgtcgctaggcccagggactgaaccgcttgggggttgtgaaaagagccctgaatggccacgctgggggccaggcgggggcctttgcgactcattcaccacagagtaacagtggctacatttatccctagccattgaaaggaggctcgattaaaacgtttgggaactaatgccaccttgcctcccctctaattagaggaaccggggagatggcgggagttcggggaccctgcagacacccttcctgtgcaccactgctttccgccctttcctttcaggagacaaaagtccccccccttcccacctgttgcccggcccctgctttcccatcctttcagagctccagtccctgccccaagcagaaggcccagccaactgctctaggacgcccagcaagccaggatgctgggggggggcgggggggcatccgagcggaaagccaggcgtctcagaagtatcctttcggacaccgctctttctggagatagccacccccctcatttctcccattctacataggtagtcccctctccaccccaccccacaaaatttggagagaaagcatttgtgaatgaccggaagtgggttagatgcccctctgtccgctctcctggtctcctgtcgtgctgacaaagtttcttactagtagaaataatttgtgcattttgtcactagtctgtctgtctttcccttcctctctccctctctctctttctccctccctccctccctccctccttcttggaaaaatgtctttaagcacctactatgtgcctagagactcttaacagccccccccccccccccatcttcctttgctcttagcctacctttaattacatcttaactaaaaccggacttgattcctccggcaagctattgagtctctttctatagctgtaatgtcaacatatttctctttatctttctcattgcttaataggaagaatcccagacacaagctattagggacgtaaaagacaaatgagaaacagaagtcgtttgctaatacagatttttgtgtggaaggaaagttgcttggttcattttgttgacgagatgatggtgtctagtatttttacaaaaatgtgaaacactttgccctaaaacaatggtgaccaagaaagtttgattcttcgctttcttcctctttttactttaacccccacccccccttcttggaaaagagccagatgtacaaagaaatatcatcaggtcactgttcttgatcatgttaatttagaaaatggaaccttggtagaagatgctattaactaaatgtcaacccacagcgtgcagaattccttggatccaaacttcaaaaacaaaaatgaaagatgtcatgtgagtgaaaggaattgtggaaattttttttaaaaggcctaaactgatcttaatagagttttattgcttccacaccctacctcacaatattttaatttaacagttacagcatgcatgccattggaacataagtccagcctcttaagaagctgggaggagcaaagaagaggaaggacttttttttttttaactggctcatttgcattggagaaaatgacaatttgcaaacatttcaagttcctggaaaccttgaaatagaaacccctaatctataccgtctgtgatttttatcacaaaacctctcatttttccatttcagctgttgatttgaattttaatgaagattaacatacatttggtcaagggtgcatccccataagtatgcagagggtggatacaaacctatataatagtacttagatcaagattaaaaagaaaaacaagacggaagagtcccctccagctgcttcataataaacaccacctccatccacccactagtcttgtttttataccctcagatgggtcttatactttcgtgaattttatataaatgggatcattcgatgtgcattttttgggtgtcttttcttcaccatgtttgcaagattcattcacttgaatccataccagtaagtcaatgtagggtgcaaataatttatacaggtacaaatgaaaatcaaacagtggagaaagctttagtttagacaacctgccccataaaacacccacattccattatcatccagaaagataatcctaagtgaataaataaaattagtttatccatacatagtaactgtgggttacatcattttcaagatgcaattgtgggtagctgcaagaagagcagaagccacaggctgcttttgtaattggattctatttcctacttgccatttcatcccctaagactagtagtaagtactttgggcctcttcacaaagaatggcatgaacttgagagggaagtaaattgcatccagtttgttctgtctcagacgtgtaagtccttgatgcgacagcctgtcaagtgtgttttgaattctgtttgaaagtaaagtgttcaatttgcaactaacacagttaccctgtttgtaggtcaccacacagaccagttaacttcagagaaaagcacagcaaacctgtagaattgtaattgtcctcctcaatgccccttccctcagaaatctgcccacaaaaccaacctttgcctaaatttatgttgccgatgatcaagcagagacacccaggaagaccgtcatcaccagtcctctcttccctcaatggaaacaggagcatgcagactgagggcctttccctcaggaagggtagtgtctaggaataggtctatgtgtgcaataggagagatgagagcattgtgaaacatgtttttggttgattatattggacttttgtaaattcaaagttgggaacattctgttttataatcttaagtctaaaaattaatgtaaacctataataaagcacagagttcactccaaggaaggcagtatggggttaataataagataactccactgagttatcataatatcagacaaataaattgaattacttatttaaaaatatagcaagggccagtaagattgcccagtttacttttatttttctaataatttatttttatttttgagcattgattggtgttttgccttcttgtttgtctatatgagggtgttggatcccctggaactgccatgtgggtgctgggaattgaaccccagtcctctggaagagcaaccaatgtttttaactgctgagttatctctccagcccccaagattgctcagtttttaaagatgcttgctatcaagtctgatgatgcagttagatccccaggacccatatagtggaaggaaagaacacacacacacacacacacacacacacacacacacgccatactgtaaaaaagagacaactatataaaataaaaatagcaatactacccaaatactatggatgttgagacactgatctcttgcatattacctagtgtgagtgtaaagtcaccctgaaagatattacttataaaactaaaaatgacttaccaccctatccagcaattacactctagactagggcctctataccagagaaatgagaatttatgttcatagaaaaacatgtatgcaaatgttcatagaagattcatttgtgaaataaagaaaggggaaaggaaagagaaaggaaagaaaaaatcatattcatgagccatctctccagcctgatttaaaatgattacagagacaaggacagattagttatgccaagaatcagggaagaggagatgtatgagtgcaaaagggtagaaaggggggttacctggtgatggagaagtctgcaccttaatttgggggctgctgcatgaatatatatatgggattaagttgcataaagtgaaacacacacacatacacacactgctatggcctgatgtgtccccaaacacattgaaaacatcacccccaatgcagaatgttaggaggtagagcttagtagagagccctgactaggttcactggaaaaaaaaaaagaagaagggaaaagggctggtgagtgtgacagggtcacgtgagaacagaggcttgccccttcctgcctttcctccaccatgtgagaatgtagcaagaaagcctcactcatgccttcctgtgctctcatcttaggacctgggatgttgaggcagaaagactgttgtaagttcaaagccagcttgggctacagaattatggtcactgtctcaaaacacccaaaagaggaggaggagggggaaaagaaggaagaggagggctattaccatattttgcatatcctggcacctagtacttggacttcctagtctctagaactgtgaaaaactgctctttataagtagcccagtcgcaaccaatctgctgtagccgtgtagaactaactccctcatatgaatgcacataaaatggagccagttatataaggtacttaatagtgctgcacaaacatcaatgtcctgggtttgtggttgcactgcagctatatactaagtcaccactggggagtggtggctgaagggcagatggaacactgtgggctctttttgcaacttcttgggaatccagcgttatttcaaaagaaaaaagatccttcaatcagtgtctcattataagactttctgctgatgacaagagctgtcctaggtagattttcataattaataaggcaatatacattttcataagcaatgttcataatggttttattaatattatatacgataattgcccactgtgtttcatgtggagagctccaatattgaaaatgaaaaggttttggaacatcaaaaatattgttcattcatttgaaagtcctcgttctttgggggtagatttaactgtgaattgtcaatatcgccaagagtcaactatggtaaattaggtagatgaccaaattgaataagactttttttttttaattgaaggcttatagaagatctctcacacatgtattctaggaaccggttacaaagggaaaggtttttgtttttgtatttgttgtttgttttttcaagacagggtttctctgtgtaacagtcctggctgtcatggaacttgctgtgtagaccagaatggtctggaattcacggagatccatctgcctcttcctctcaagtgctgggattaaaggcatgcgccaccactgccctgctaaagggagagttcttaaaatgcccctgaaagactttgacattagtctttgtccagggccacacttagaggggaaacccatttgcatgcttgaattctggtatttgtcacatttctagagtcacactggaaaaatggttcttggaaatttgatgcttattttaaagatgctgtcataattaccatatgacaaagtgtctttttatatggcacaaactggcctggaacttattatgcaacccagtctggtatccaacttgttaccctcctgtctcagcctcctgagtgctaggatttccatgtgcaccaccatcaggtgtttaaggcagtggttctcaaccagtgggtcatgaccccaaaatgtcaaatgaccttttcacaggggttacgtaaagccatcagaaaacatagatttttacattctgatccataatagtagcaaaattacagttatgaagcagcagcaaaaataattttgtggttggggttaccataacatgaggaactgtataaaagggtctcagcattaggaaagttgagaagcactgatttaaggggtagcatttattagtttcctttttttttctaagacaaggcagtacacacttctttacttggtttataaagtcttccatgtgaaaattttatgacctctaatcactgtttcaactttcataatccctccacgaaagaatgactcaacaagaattagttaatcaggtgaaaatttgcctttattatgaattcagtaggtgcacaattatggcacacttttcatttggatccttcctttaagatctggcctgtctgcctgcctgtaagtggatcacggcatataagcagtctgcactcctactgaaagcagcccaaattacaaatgacttggtgtcagacagattttaaacttgggtgccagtagtgttttaactatggggcttgttcttttctttgactgttgtattattttatttccactaggaattgtggagttctaaatattattagtggtttaccacttttgcacacatgtgtcctattaattttggagacatgggaggaaagtgacaggcctcttttctcccccccattcatctacctgctcacacagacaggcccctgtctgtttagagttcagaagggaccacacagacgctaagaaacttgagcacaagaactggatcatgggtatctgggggcgggggtggagggatacaaaaacctctagtaactagattgttttggtttttagttcttgatttgcttgaaacagctcatgtaaaaattaaggcaacttacaatgtacggcttagctctgtaaagcctttaaagaaattttagagaaaacagaacacttttacttaaaaaaaaagccgctaaaactacataaaaaattaatagtagactaagcccattcattctgaaatgctgtaaggagtaacaaacttgggaatttgtgaccttagtcttatgtctacacaacatgatacacacaaaatagcataagaatagaaaaaaaactacaaataaagatcacattaaaacaggtacacttaaagcaaaacaaattaagggagatcaaagacctgcctttagtttcctattcattctcactgagtcatcttgcttgcacttagtgagcacctatagtatgctgagcataatgggcgttgctgtggatacaaacaaagacaggacatctggctggaggagggagagaggagacacacatgctaattaaaatattacacagagtacgtcaatataaatatgaactgattggtaaaagatcgcagcaaaagaagctgctatctgggaggcccaaggcaggcttctcggaggacacgacgttggagctgaattttggaaagcaatagaacttccatatggaaacaaaactctgagtgagcagggtgcttccagcatgaagagggaaggtgatgctggggtctcatgatacagacgagcagtagactattctagtctgatacagtccagagtttctgtagcggagcagagaattggcttgcatgtgagcaatggggacagggtggactggggcctgtcagtcaagcatgtggttaactgttgagtatatttagttttccaaacacatccctgtcatgttgactcctaagtgggaaagtcctatgagaaacacaagtgttcgaatgagaggagaaggctcacttcctccaatccctatccccaatttgtcagccttggctgacctggaatgctctatttagatcaggctggcttcaaacttagagatctgcccctgcctctcgatgaccaggatatctttcctgatagagcagagtaatggaaagatacaggatacagagggttgaaaatgcctggggccaggagagtggaaagggacagactgggcttgttagaaggagaacagattgtaatgactcacatgatgctagaatgatgccccccacagtctagcgtccagtcttccttactcgggtgacccaggtttcagacttaacgtctctaaactctgctatctctggtcccagattcagctgcctgctagatattccataacattcccaaggtaagcacctctccataatcgattcccttctcggctaatactccatttccctagtaactcagccttaacattttcagagtcttgatttctccctccatcacgctgactctgagaaccaattcttccccagtgcttgtaagttttgcagaaacttgcctcatctcctttcttctccactcttgatgctgggagcctgtaccactaagctgctttcagcttttctagtctgctcattgaccaacacgtgttacaaattaactttccaataccctctgtttgttttgggagacagggtctcatcatttagccagagctgaccttagctcctggtcctcctgcctccaccactagttagtatgctcccatgcctgtcctccagaaaggtccctgtcttgacacacttctttctgttcaagaactgaaagtgactttctagttgctataaactgtccagttctaatctggtcctttatagttgggtcaaatttactgtctaagggggccctgcaattgttctgcgttttacactattgatgtcacagtccatacctggagagtctccctcttctccccgtagtcgtcgtcattacataagaactggctgagatttctaccttttcttggaaatactgttgccttatgattatatcactgcatgagttaatgtgtatggaatacttccagggaggctgcatttgaattaggttagaagaatcatgtcatgtgactttccggcattctaccaggcacacctgcttttccttatcaagtaagtggacgagctaacatggaggatccaggcttaggtggtcttacttgagaacccaggcctcatcattctcatctgtccccagtgaaaacatgtacccccattctcgacggtttattttctatcccatttatttgacattattctattaaagactcttgtgaacaccatctttattgtgtttgctatgaatttcctgccatatttcaatctacttaaatgtaaggccacatcttttttatttttatttaaattctttaattaccactcatatttacatatccatccccccattccttcccccttccatcctcccatgttccccaccatctcccccctacccaccccctaactcctccccagggacagagaggccctccaccaggcaccttcaaagtctgtcatatcatctgggggagggcccaggctctccttgctgtatctgggctgcaaaagtatccctccatagggaatgggctcccaaagtccatttgtgctctagggttgaagactggctccactgttagaggtcccatagacggccctggactcctagctggcacccacattcagagggctcattttggtccaaagctttaagactagggtctccatgctctcactaggtcaggtccactgtttctgcatgtctctccagccctgtcttggctcctttggtcatccctccttcctctctacaactgaattccagtagtatggttctgtgcttagctgtggatgcctgtttctgcttcaaacagctactggatgaaggctctaggaatggtaaccaaggtagacaccaatctcattataggggaagggcatcaatgaaggccacatcttataattattttttttgtcataccctattgatattacaacattttctgcggactggaaagatgactcagtggctaagagcatttgttgctcttgcatagggtgtgggtttggttcttagcactcaatagcagtttacagccatccaataacttctgttccaggggatctgatgccctcttctgaccagataccaggcatgcacatgatacatatacatacatgcaggcaaaacactcacacatataaaataaagtaagtaatctataaaactattttctgactactgaatacgttgaccaatctggcagatgaatgatgtgggtaaaacaatttgcagaaaattgtctttgtctatgtatccaaaggtaaaaccctgaaaataagaaactgttctaaccaaccatctcagcctaatgaatctggagtccaactagcacagtgagggtgtagtagcttacatttgcatttgtatgaatgacatttacaatgctctgctaactgttggttggcctgattgtagttcatagaataatgcctgttatcttcaataataatggaataagagaagacatctgcttataattcataggtaccatacctaaaaggtctttccattcaaaataatacactttcttcatactttcatttacttgctttgcctaaaacttgatttgtattttgtaagcaaaagctacacatactcaataattaataattaaaagacaaccattccgcagctggagagttggttcagcagttaagagcaccagaggacccaggtttgatttccagcacccacacagtacttaatcattggtaactataggggatttgatgccctctttcctcctccatacacactgcatgcgcgtgatacacaatatacaaacagacctaacacccacacataaaataaaaaatgaaaacaaaacaaacagacagaaatcacaaccattccatatttgacttgtgggggagatcacatttaaagtgatggaccacaaaatgatatggccccagtagatgaagccacttagtcatgagtcatgactgtcttagttttcatacctacaatacacttatgctgatacaaagacaaaatcacccagcaacaatacagttctcaaaatgcattccttttattaaattatatatgattgtacttataaaagcaagaaattggtacaaaaagatctttttaaaaattacagtgcattattaaactgaaccaggggattatgtctctttgaactgttgactttggcatgatgcttttccagaagcaaccagcatgaagtcagttcataggagagttgcaacagctgttatgaaggatcttgcctttcattgatcacagagttgccaaggcaaagcgactaaactctctattggctataccaacagaaagttgagaaagagttaatttcaacaatgcaatatttcttattttcatcatatgtgtcaaagggacagttgaggtcttccacagttctaatagatatattaatttttttatagtactgagggtgtaacatcaataatacagttgtattatctgctcagatcaaaagctaatgcatcctatgaacaacacgaatgaatctccctaatgagatttgagaatagttcatacaccctctgcatgaactactaactagaaagtttgttcattgagtgtaggttccactatctgcctcctgaaatgtccagctagtcaaagggtacatccctagacttttgcaagctctaacacttttggatggcctaagatgtacaggacgacatgccaagccctaggggagtataaacaaaaggaagggtgaaataacatttatttagcagctactgtgtggtaagaacttttatatcacattgcttttaatttacatgtcaaatctaggagatatgtgtttggtctgtctccaaaatagaaacagactttcaaagaggttaaataaataaattcaggctacatggcttctaccagagttgagatttgaacccaaagcttccttccccaaactctattcttttctacaataacatagaaacttttgaagatatgaccatgaatttggaagtatggtaaagagagtaatacaagtctgaaatcccctgtatacatgaggctgaggctagagggctgaaagttcaaggcaaacctgggctgcatagggagattttctcaaaaaccaaccaaccaaccaaccaaccaaccaaccaaccaaccaaccaaccaaccaaccaatacctaaataaataatgcaaagaaagggagagggaactggatgggacacaaccaggaaggtttcagattttatattgtaactattgtatatcatgggtgtgatgttaactatctctagaaggacctagcacacaaattagctatttttagtcacttatgcctttgggaacacaactgtgacaaataacattttaaaaattattattattattattccttttttttatttctgtgcatgtgtgactctgtttatgtgtgccacctgagcccaggagcttggagtccagaagagagtgttggcgcctctggaactagagttacaggctgttatgggttgccttgtggatgccattaaccgaatctggatcccctggcaagagcagtaagaagagttcttagctgctaacgtcccaattacaatttattttttgagtttcaatactggggatcaaatctagagcctcctgaaactggacaggggcatggttgacaaaatttcatctagacatgccatatgaggtactattatatgaagtaagcccttctcagtcatcagtgcaagggaggcggctcctagaatagcttcctcgagccacacttcctagtagtcacaacttttgtgcaatttccttcctttccgagtacgatccggatttagtgaattacttccatcaaagacaattcagcaaatgtggtgggggagcatatggcgattctagctgttttgagggccctccgtaacgatttccaaagtttctggataaatttacatcccccagcagtggtggctaaccccccattctcactagcatgctctttcacttgttttcttgaggacagccattttgactagggtgagatggtgtagttttaatttgaatttcctcgatggttaaggatgttgaacattttcatacatttattggctatttatacctcatctgttcatttcattgggtcactaattggttggattgattcttttcttttcttttttttttttttttaagatttagtttttatgtatataggtgctttgtttgcatatatgcctgcagaccagaagagggcatcagattgtgaactgccatgtggatgctgggaattgaactcaggacctttggaagagcagccagtgctctgaactgctgagtcatctctccacccctacttttttcttggtatatgtggcttctagatcacctctctctctctctctctctctctctctctctctctctctcctctctctctctctctcatacacacacacacacacacacacacacacacacacacacacacacacacagtatgtaaggcatgaaagtagaagcagggtaggaccagaggaattaaagacattggtggggcagaggaggagaaaatggaaatatggtcaaagtccatgatgtgcttgtatgaaactatttctacgaaacaaaaaacaaaaaaacaaaaaacccccaaaacaccaagccatcactatgtacaatgaatgtatgtcaattagaaaaaaatagtattgggatgtgactagctggtgagtgaccatcctgtcctctcgctgtgtggcactgatgcagttgatgcaggctacgctctgtttagagacccacatggggagaaactgaggtcagaccagcagccaacagccctggaagaactcatgtctcagtccattggccactgaggaactgaatccttccagcaaacatgtaaatgagctggggagttaattcatccttgtcagactttgggagacctttgtgacacttagacctacattaggggatctagtcaaactgcactctgaatcctgacccacaaaaaacttcaaggaagtaagtgttgctctgaattcctgtttgggttaatttgttacatagcaaagatagctggtacaaacacgcttctcttctgtcaggcactatctggtgctgggataatagggaatggagggctgtgtctgagtgtgagtactgaaaacctccactcagggagctgtgcgggctactactgtacagccgtctcaagtctttcttattccagttttacattgtttattttgtgcttagaataccaccgtttgttgtaaaatgattttatttctttatttttaagtctctctctctctctctctctctgtgtgtgtgtgtgtgtgtgtgtgcattcatgaatgcatacatgtgtacatatacatttgtgctcatgggtgtgcacacagacgcctatggcgtttagaagagaatgtggagcaggagttataaatagggattgagagatgccaaatgtgggtgctgggaaccaaactctggtcctctgctagagcagcatgtactcttagccactaagtcatgtctccaacccttgtggattacccttaaatagagatttttaaaagtaatttatttcattttattttatgtgcattcgtgtgagagtttcagatcccttggaactggagttacagacagtgatgagctgccacatgggtgctgggaattgaacccaggtcctctggaagggcagccagtacccttaacccccaagctacctctccagcccctaaatgaagatgtttattcagatagccatctatagctactactcagaagtcctcactctacacccaagaatagctataggcaaaacaaaatctagatagaataaacccaagttccattttgagtcgttttgttagtaagaaatactcttctggcaaatgactgttatcccagaactggagagactggagccagcctgggctcatagagtgaccctgtcccagaacaaagcaacaaagccaagctatcaaagtatctcagtattgaattttatgatactttgtatctcttagaagttgatacctaaaggcagataagaactaaaggaggctcttctaggcaacagcaaacatataaatgacccaaaaagatgtttcagatttacaagactgagaatcatgctgtatcgttttcagagaggtttctttttatagtagagaaaaagaccataggaaatacctaatgttttgtgttcagtcaacacatcttgaaacggatatattcctatggcagtaatagaattctatcataaaagacaatagatggtaggtctttatttttttcccaaagactacacgactttggtggataaaaattagggtgacctaaatacgaacagattaatttatatggaggaaaagttacaaatcattcacttaaaagctggctccatgcccacattctagcagtacacttgggaggcttgtcgctgtacagctaatgtctacatggagcggatttctgaacataatttatgtagatgaagtgtgcagaatgtttttatttgttctacatctcactgtctcacctctgcatgaacttccccaggccagatctactccaaatagtctcactccccttctccacacttccctccaacgtgtttgccttggcaactttcacgttcttacaaacagttctcccaaggaaatcaatcactcttgcacccaaagagaaatactgcgcactcagtgcgatgactaaatgaaacatggttgaggcaaaccatgtgttcccgcgtgtcccggattacgctgtttgctccaggaacatgttcctaatgtgtttggcttctgttaccccttgtgattgcaactttcactgtcttttggaatttatgatttcagaagcaacttcttggactcatttaacaagacatttttagagtgtgaagcctgggggactcattgggcctcgtcattctggtctcctttctagactagtctggcccaagcaagggcacctgctgtttgaggaattgtggggaggttgatcttctcttccatctggaacaccagacagaaggcttatctaaatgacatgtgtctattgtgctttgaaagctatttggttcatcaggcacattatttggagatatatatatatannnnnnnnnnagagaaatttggaagttcaaatacaaagaaatgataaatattaagaagatggaaatcccagcatttgggaggcagaggtaagaggactcacgtttgaggcccagttgtgctatcattgagagtttctagtcagactgggctgcacagcaggactctgcctcaaaaaataaaataaaaagagagaaaaaagaagggggagatgagggtggcccctatttaatcattatacaacaattacatgtttcaaattttatgtttcatggctggcaagatggctcagtggggaacggcaccagccctaatactgaggacctgagtggtccccagcactcacacagtgggaagaagtgcccctttggcattcgcattcatacacagcacacaagtgctcccccacaataaacaaataatacataacaagaaatcaccctgtaaactactgccaaattattatcctggaagtatgttcacttatgtgtcaataaaggggggggagaagaaggaagaggagatggagtaaagaaagaaagagaaaagaaagacggaaaggaaggaagaaagaaagagagaaaggcattctctttgagctgcctccctggaggccctcaaggtaccaaccatactcacattgtttactaaacattgcagctgcaagactaccaattctatctcatgctggggccaccaaattaaccaaaatgtcccaccagctccctctcctttggtgtctctttccttacccaaggatcatcatagggagaagtcagggtcattagcactttgaatttttgtgctttcttctctgaaactcttcagaggtcccaggttccccctccttttttttttttttttttttttttttaattctactttcctgtggagcctgagaaactgagttttgtgtaagtctaaggtggttttgttgctgctgtatgtatgtatgtatgtatgtatgtatgtatgtatgtgtttaatgtcaccttaggggctggagaaatggttcagtggttaacaacacttactgttcttgcagagttgggttcccagcacccacatggtggttcataacctgtaactccagttccagggtttctgaaccctcttctggcctctgtgggtattgcatgaacacggtgaaatataaggatggtggtggtggtggtgggaacattcatacaaacaacatgaaagaaacccacactattttccttttacatttaacttaattaaaaaacttttaatatttgtttactcaattttgtggtgctgagagttgaactgaggtctttatgtttggcaagtcctctgccattgagctttactcccagctcagttttagattatttagagccacaaatggaacaagtactttttcctagtgtgtgggttgaatgagaacaatccccataggctcatatatttgaatgcttagtctccagttggtgggactgtttgggaaggattaggaggtgtggccttgttggagaaggtgtgtcactgggggtgggctttgaggttttaaaagcccactttattcccagttacctctctgtctctgccttatgcttatggatcaggatgtaaattctcaactacaaatccagcaacatgctggcctgcctgctcctagtcacaatggccatagactccaactctctgaaactgtaaatcctaataaactcttccttctttaagttgccttggctatgatatctgcacagtgatggaaaagtaaccaagacatctagcctggagtctcatgcattgaaaactaagtatgtgaaaaggaatcaatcactttttttctctttcagcaatgggaatgaaactggcttggaaggatcacaacagaatctaagcagaagggacaaaaagagacctggatttaaaagatgggggtggaatggggggggcaggcctataatcctaggctgaagcaggaggattgcaaattcagagtttgcctgggcttctaagagagtttaaggctagcctggaaaaactagcaaaaccctatctcaaaagataactaagtaaagagagagctggggatgctgcctggagttagagcatttacctagcatataaaatggagaaaggaaaggagggtaggaggagggagaaagggagagaggaagggagggaaaagaaaagaaaggggatattagaactgacatattcaagagacctgggaaatatacttctatgtagtaagaaacatgttcataaccaaacactaaggtttctattaggaaactgttgactccagggcagtgaaatgaaacttttacactgtcatcatcctcagacactggggagggagctcttggtgcttaaaagggatcttatgacactccattgtttaagatcacaagcttgggagcacaaacagaggacaatggtctgccactagttaacctggcaaagaaattatttaacttccttaagtcttagtattctcagttgtaaactgggcaaaaatatctacctcaaagatgtattttgacagctatataacactgtggacataaatagtggcacatgacacaggtgaaatcagtattaattgttatcaacatcatcttattatcaccactgccagtgatttgaaggtgtccctcttaaaataagcacaggagtctttttttatttcttttctattttaaagttttcttcatttttaattatgtagataagcattttgactgcatatacatcaatacaccacatatatgccgagggctcacaaaggacttaagagggtgtcctagtccctgaaaatggagttacaggtgtttgtgagttaccatgtaggtgctgggaacccaggtcttctgcaagagcaacaaaggctcttatcactgacccatcttgtcagtaccaagaactggattcttagtacccagtgcaacaacattgagaggtggatccttaatgggaggtgtttaggttatgatgaccctgccttcccatacacaataaagctgcaatagctggagttggacttggtgtcaagggagtaggcgccttacaggtggacagatttcagctccattttgcctctttctcatgcatgtgatgccattaccagatgcccgtgctgtccagtgctttgcttttggacttcccagactctagaactgtggggagacaaatttctgttctcacaaattgcccaatcttcactgttctgttacagcagcaaagagtaacctaatacacaccattgttgacataccactttagaagttaggaaggcaaagtagaaatactcatgaggattaaggggccttaagaaaggaagacaaagttttaaaatggagaccagcttttgcagtttgagccttggagatgggatgggatttgtcatccagtatcctttgtctccagttctaagactgtatcacactgacacaggagtgcccctctcttatagatggaatgtttgtgtcttccctattctttttttttcaagacagagtttctctgtatatccctggctgtcctcaaacttgctctgtagaccaagcaggctggccttgaactcagagatccacctgcctctgcctcctgagtgctgggattaaaagtgtgcaccaccgtcactgctgtgcaaccaccacctggctggctcatttcccccattcttatattttatgtattgtcatcccgacccttagtgtgatgaaatttggaggctaggactttggaaggtagtaaggtttagaggaactcatgtgggcagggcccaatgatgggatcagtacctttctaagaagaggaactggttcgagcttgcttgctctgttgggtggggacacagcaaaaaggttacttttgcaaggcagaagagaattctcactaggcacccaatctttccatccttgactttggatttctggacttgagagttgtagaagtgagcaccagaggtttacactacccagcctgttttgttattgtattgtagactcctgtgctgaataggatgctcttgcaggagatggagccttggtcccagcctgcaaagacgctgcccttcaagcaggcacatgcacaggtcctctggacaccagacactgctgatgtccttcttttgagtggcaggcccagaggttgctgactcatggaaatccgagtttgaaatatcagaactattctcttggttgattctgaagacattacattccacagttatgatttttgggctggtctgaaagttttgctttccttagttcctttatctctgccaaccatttcccaaataacagaaaggcaggccgtttttcccggggtctttcctttcctgttataaactcaaggccatggatatctctgagggaaagaagccacaaacccccttcacgtttctcagagtcatagacaatttagttttgagttgggggcatgtatggtccttcctgacatcagccaggtggcaactgtcacatggtcgatgcaatcacgattagcataaatcaggcaattgaagggtatatccaatgggggagagacctagttcagatgtcttcacttgtggcttcccagcataaacaccctctgacagaggatgagggagacacggattcatggtttctaattgttcatttagctttcatttcctcaactctgcctgctcttggaggctaccacatggcatttcccagtgatcactagcttaggatccctgtgactgcagatgcgtgtttccctgtgcatttgaagtgatccatccgtcttaccctgcacttgggaagtcttctcactagggtaaattcacttgttccttgatcagatccaattcgataatttcaatgctggctcattgacatttcctgaaggcgctttctggtggtgagctcaccaagccagcacagctcaacctcattatttctcctaagattgcaccacgggaaagctcacttcagtagacatagctgaggatgtcagaggatgacagagggggaactactgcccccacccacagctgtacattaaaaacctctctctctctctctctctctctctctctctctctctctctctctctctctctgtgtgtgtgtgtgtgtgtgtgtgtaacacatactacagtgcacatgtggaggccaaaggacaacttgttagggacttggttctctcctaccacgtgggtcccaggattgaatttaggttgagaggttaggtggctaaggactttcccctctgagccatcacaccaacttggtgccattttcttaataatgccatcactagccaggatattttcatcctgttctcagttactagccagcacagagctatggcctagtgatccccaggcagctttacagatcaagactgtatactctgaaccctcatttgtccattgtcagacctgaagcttctccggttttcctagacagtggccagtggctttgcaatgactcagtgcaacagctgtttaatcgcttttggagcaaactcaacaactttactggagcaacgttgaaatgaagctttcttgggtgagttttgagagaggaaaggcaagaggaaggaagagtttaaagggaccaaggtgtctgtggagggtgttggcctgtggaaacccagtgctgctcgtgcttacacgctgggacctcttgccttggccccctttcttaagacagatactcctttctttcttctcttttgttgacttggataggaaagggcgtgcgatcttttcattcagctcaaacataatacaagaagtctcccgcactttggggacatgtggttgtgttctaagggacatctgcaggaagatggtcttgggaaaaagctccttctccagaacacagaaacatctccggagtgagtgatctccgtgcgcacagattcaataagcccaaccacacttggctggggcacaaacctaatacggcagcccatattgttgctcgggaggtctccagccaaaccgacttcttgtaaaaataaatactcatcagcaaatattttgattagttaaaaatgttcgagatggctaggccctcgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctgctgccctgcctcctgtgccccggtggtctggctcctccgtgtggtgcacatgctaaacagattaacatgccttggctgacccacgcttcgcaacccgcggatagggtttctgcagctccatgtggaaattaacctatctgtacccgtggtcagctgcgcccggctgctcccgctctggccgggcaatacaaacaaacccaggccgctggccccctccctccgtgactcttggcctctctcccctttcctggccaaatatttattggaaaagaggttcttctctttggccgaaggtagggcacatttctgagagttctttatttgtaaatgattttttggcagggccaggcacccttacgagggaggtggtagggaactcattcatggttgggagctctctacccctttgcaggcagggagctatttgtgtttgttcagagcacactagtcccggcatgaaaaacactcaggctgtctgtagattgcttttgcaacagctcctctgtttaacaggatgttctgctttgttctagggcaaattccccctgctccatctctgcctacgattggtactcactgagtacggtgaaggaatttttctagattttctttcccacttagatgaattgaaaaaaggcaactcagaggttgatgggtaccagcctgagcccaagacttaatcacagctgcctctacctctcgaccaccactgcctcctccagcaacccagggtaatggagggattattaatgggtctccagttcacttgctaagcgttttccgtctgtatcccattattcaaccgataataacatgtaggcagctcggcttttcactagatagaggctggagggaatctgtgcgggttggacagggctgctgtagtgaccactgccagggagatggatggagcttttcagattccttaccaagaccttcatcctgaaaatgcccccattgtttgggaaccagggatggctcttttctgagataaccactattctcgacttaagcatggtcaccttacctcactactcaaagtgagcccaggccatccgaagttcctggccagcccgtcattcctccttggtttctggcagcctgtcatcaagttgggggtggtttgggtgtgtctccagtgctgtttctcaaggcctgtggcagctatccatcctgctggcatttactttccagtgccctctgctgccttggcattagtgaactgcgtgagacctgcaggtggcacccatcaagctgtatgatgggtgtgatggcagcacccaagaggcagacccacagtaggccacagtcaggcacaactgtccacgaatagaaccctgtgtctcagccagccgagtgtcaggctggctctgttggtttatttggcccgttctttccagctgtgtatttcttggatggatggcatgttcctgagctagaaaaggttttcagagtgcaaacttccagaaaaataatcagaaaccaactggcagcatattttagctggtggcagtgtgattctgaagggtcgaactagcactggcgtgggtaatatatgcatagttaagaactgcatcaaaatgaagatataaatagatgtgctgaggaggaagaaaaaaaagcattgctccccccaaatatgcactgccatgagaaatctagatttttctgctaaggcaagagaaaccactgggcctgaaaagaaaaaagaaaaaaaattgaggcacaaggctcaaagaagcacaaaggcctgagccagcccaaagctggacttccttgttacctctggtatggataacacctcggaattcattccagctcaggatggtggggtctaatcagaggctcccaggagagcatgctccacattttcatccaggcagctggcaccctaacttctggggagcctttttcttcatcagcacctccagtcgatgttgtccatatggatgcacgtgtgggaacacacattgcagcaacttttgtcttttgtcgtgaagggctgacagggcaataaacactcacaggctccctcctccaggaattcctcctcctccctgtgtggctctagccctgtggataatatcattacaggactaaacaaataagcagtcgatccgaatcaagcaggaggcactggggactgcgcagttcctctctgcaaagatgagacacgtaaatttacactcgaagcttggaagccctccagcagccatgaatagctgttcagttctgtcaggcggggaggagctggggtgctcggctgaccccagctccagctttgctcccatcaatgtgagctttcaaggttctgttttccttaccatcgacaactgagatcaacaagggccagtaacactttttatgaaccctgggctcaaagaagctaagctgactacagagttagcatattaaacccagtgacatggaggaaaacttaacacactcctgttagctgcttccccttccaatgtgactcccatgttcaggttgtcactgctcccatgctacagataccagagttacctctgccacaagcgcattccacaggcacgttgtttctttcttcttcagcaagagaacatggactatagtaagggatgcagcagacagtcaaattctgaccaacagagtacttaatatatgttacctttcctatcaagttcatacattgagatgccatactctttaccatgtatgaataattttttttattcataaaatttctttactggaaagagttcttatcacaataaaatgagcactacatgcaattactatgtttaaaagggaagctttctttggttctaatgatataagtatgtcacgtgtaacagttcaaaacccagagactatgtcacagttatggagaacaattttcttattttattgtatgtttccctttttcaaatacatggcagttctgggcttgaaaatctggtttttctttctttctttcctgaaacaatttcataaaagacattcttgctgagctccaactaggacacagactgctatttgccttttgtcgactgttttttgcttccttttagtagcaaaatctattagctgagcttaaggctacccctacagactacatttcccagggtcctttgcaggtagatttggccaattggaaataagtggaaatgctatacttacatagaagctgccgctcttggctctctttttcttgcagcttggttcaagggtacatagtggtgagggcaacgttgtaaggatgacagagcagcacaatgggaggaaactctgacctactcttatgtatcttttccataagagatgcacctattttatttcagatactatcattgatctttgttaaaactgcaactgctgtttccagcatggctccggggttggacctgacttgggtggtgagagaatgaagaaaagcaaacacacatagacaggcagacagaaaagctgggcctgagtgaactgcgattccttacagaggagccacacatcccagaagctcagcatgcttattatacacaagagaacagagaggcagggtgctgaagacagctgaatcaaggaggcagtgtttatggtatatgggtgagtcaagatttacctctgtaagagagcagacttcaggctgtaaacctaaggggatggagaaggctgcggtggacattttctgcacacacacaacactcgtgctaagaccaggagggaagattttgcatttttcctgagctgagactgagaaaggttttgctattttcctggtgggtttgaggctttggggtacctgacatggccatgttcatgttaaacaatgcacactcactcagaactttactcattccttacaataatccaatagtccaacaaatgcaacaaatgttctgagtttattgtctcatataaaagagtgggactttatggatcataaagaacaattttaagtcataatttggaatacaaacattaataaatatgcatgcttattccagtgtctgttgaataaaagaaaaccttttttttttctgaagtatgccttaaggaaaggggatagcacaatatagatgacaaggcaatagggaatgggggtactagatgtgaaaatgtttgagagggatggggtggacagatgggaagggagggaggggcaacccaaacaaagggtatatgaaaagtcatatgagggactagagagatggctcagtggttaagagcactggctgttctttcagaggacctgggttcagttctcagcacccacacagcagctcacaactatctgtaactccagttctaggggatctgatatcctcaaacagatgtacatgcaggcaaaacactaatgcacataagataaaaataaatttaaaaagaaaaatccatatggaaatctattctataaaccaattaaaagaggtagctaaaacaattagttagaagatagacatcctgccaggctagacaatgctgttcctaaaatccgtgagttattgaacaaaaatcccagttggtgaggtcccagaagcccctaaaacaataaggctaagccaccatgcaccatggttacaaggtatagagaaaccaaaccgtagcttcctcccaccttcacctttcatcgcatggagggtgctggttagacttcctggggagccttacccagtcattaaccttacaaactacaatgccaacctcgcagacaagatcgccttgttgctacagtagtggcataactgtcacagggatagccaacaggtccatgattgtatttgaagcccaatccacaagaaaaaattcatgtctgacactataaactgggtcaaaacttgtgaccgtggaggtctaaatactaggaaagaatacattactgttgtttagctaaattgacattggtgctaaactggttcctaaatacttatatttatagccatagatgaatgctattctcagccttaatcagagaagtttctctttgtagttataaggtgaatacagactctcatatctgctcatggtgctgagaataaatggtagttgagtgctcagccccaacagaacatttataccacctcctctaagtctcaggaagcatcatggaagaggaggcagagagaatgtaaaagctagaagacagggagaaaggctgtgaaatactgtcttctaagcatgacacagtcattgtgattttcatctcatagcagccatggctgcctacactgggcctgtcaagagtcaatcatgtatctgggaggggttctcagggtcccatccctttccacggaactatgggcaactatgtgcacatacatgcacaagccataggccagtctggggtcttgttcctcagtgtaccggatggttttgtatgtcaactcaaccaagctagagtcaccggaaaggaaagagactcatttgaggaaacgcctccataagatccagctgtaaggcactttctctattagtgatcaatgtgggaaggtccagcccatggtgggtggtgccatccctgggcttctggtcctgagttctatgacaaagtatgctgagcaagccatgggaagcaagtcagaaagcaactcccctccatggcttctgtgtcagctcctgcttccagaatcctgcctgtttgagttcctgccctgacttccttcaacagtgaacagtaatatggaagtataagcaaaaaaaaaaaaaaaaaaaaaaaacaaaaacccaacccaccccacccccccccaccgccccgcaaaaaaaacaaccattttcctcctagcttgctttttgctcttggcattttgttgcagcaatagaaaccataactaagacaagaggaatgttatttatctcatttttggagacacagtctctcactaagacccaatgctcacctggctagtctgacaggtcagctgatgggggggggatgtccttctgtatatatgtttctcttattggttgatgaataaaacactgcttggccaataaaggcaggaagataggcaggcttaggagacaaggagaatgctggggagagaggcagagacacaccagggaagagacaccatgtagccgagaaaggagtaggaggtccggacccttctctggtaagcaaagaccacgtggaaatacattgacttacagaaacgggttaataattaagacagagctagtcaataagaagccctagccatcagttaacaatttaataattaatataagcctttatgtgtttatttggagctgaagcgacagagggaccaggcaggacaagaaaactccagtaacagtcagcaaccccagggatcctcctgtttcaccctccccagccctggaattacaacatgtgccaccttgcttagttttctttctttttttaagatttattctggggctggagagatggctcagaggttaagagcactgactgctcttccagacgtcctaagttcaattcccagaaaccacatggtggctcacaaccatctgttatgtgatctggtgccctcttctggtgtgcagatatacatggaagcagaatgttgaatacataattaatacataaaatcttttaaaaatgatttattctatattgtgtgtttgggtgtttcacctgcctgtatatctgtgcaccacatgtgtgcagtgcctgtggaggccagaagaaggtgttggattttctgcaagtagagttacagaaagatgtgagctaccatgtgggtgctggaaattgaacccaagtcctttacaacagcaaagactgctcttaactgctgagccatctcttcggcccccatgcccagccttttgtgtgagttcaagggaatgaactcaggtcttcatgtttgtacttcactgacagagctttctccccagactcctagtttgttttttgtttttttgtttttttttgtattttatttattttttgttttcaatgcaccgtgatcagtttcccgtccctccactcttcccagtccccgatacctctcttctcctgaagatccactccttctctgtttcccttcagaaaaagcagggattgccattgaggatgacataacaaattacaataagaccaggcacaaaccctcattattattaaggctgggcgagacaacccagtaggaggaaaagggtcccaagagcagatgaaagagtcagagacacccccactcccatttttaggagtcccacaaaagcaccaggttaaaaaccataacatatgtatgcatgcatgcatgtatgtatgtatgcatgcttgtatgtaatgtatgtatgtatgtatgtatgcatgtatgtatgcatacatgtatgtatgcatgcagatccggcacagacccatgcaagctctgtgattgctgcttcagtctctgtgagccagactcttaattcttaacaataatgtttgaagttctgctcataatgggtatcagattaatgacttctgtcttgaataaactatcagaatactgatcttccctagtctgattttaagagggcacactcagtaaaaccacccagttatctctagaatggaaactacagtatgtgagtgactccttgcaaactaggagtgtttgtttccttattagaaaagcatgctggcactagccctggtgactcagtgcgtgtgtctgttgctttctcttgcatttgcacatgaagtggcttccttgaatcatttttctttgcttgatttttctagatctaaacaggatttcctatctccatcctttcccatctcattaaagccctccccagtctaggaattctctcattcacagtacatgttataactggttgtatttattatggttacttctgtgataagactgtgagcactcaaaagatactgacaggcatgtgtgatgactgcatgttcacatgtgagcgaccagcatgacattctattgaggagagagagagagagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatgcttagcagttctgacccagtgcctctggagtctagcccagaagccccaatttttaataagccttctctctccaaggtgaatggaggtgatgggttcgtagagcccctttgagtgccttttaagtaaatggttgaatggattggatcctaacaggatttaccaagccctttacctctggatcacctcattgctttcattctatttctctttaccataggagaactcatcatgtggtgggggtatgtactaggttaaatccataccttttgaattcataccctctaaattcatatccttcccagaaactttatttaattttttggtttttcgagacagggtttctctgtgtagctttggagcctattctggcacttgctctgtagaccaggcttgccttcaattcacagagatcctcctgcctcggtctccagagtgctggaggtgctccagagcaccactgcctggtgaaactttatttttttaaaaaataatttatttaaatttatgtgcatttgtgtgaaggtgtcagatcccctggaactggagttacagacagttgtgaactgctatgtgtgggctggaaaccaaatccagttcctctggaagagccgccagagctcttaacccctgagctgtctcttcagccctcagaaattttataatatgatgtaatttgtaaataggtcattggggatacactttgtgttgcagaacttttcccagatgatatgaacaaatgcctctttgccccagacatggcaccaatggtagaccaaagaaaagatttcaagtccagatggtgaaccaatgagtttgttgatcttatttatagacacataggtgaagggctacttatttacagggagtgtgggagaccctcaaagagattccttgctggaaaaccccagcccagcctgtgtggtgacatgtccaaagctgtgtagatagagtgccctattcattcagtggacctttaacctattaggtactgtagtgcctccttaggtcacatgtggttggggcaggaccatatacaactggaagaaggcaggagggaacaaacgactggattctcaggtaagggtttgatggccttattcccattgtttccatcaaggaatacagtaggcttagtcttgggagggttctgcacaggtatgcatagctgctttggtttcaagatggcagcaggtcatgacatgcttggaggatgccattccacagcacctagttaagatgaagccatactggagcaggatgggtctactgagatggctggagaggcagagggagaaggccatgtgacaattgaggctgagatgggagtgctgcatctatgagccaaggattgctggtggccatagcaagctatgaagtgggaaggaaggttctctcctcgagcattcgagcattcggagaggctgatagcctcgatgacagcttgatttgagacttacagcttccagagccgtgagagaatgcatgtctctcatttgacacaacccagtttatggtgctctgttatggcgccgtaacataggaaactaattcatggctctcactgtgatcctgccaacatgcagagaagtggctaagctctcaatgtcagcatctattttatatatctgtttgattacttttaaagagtgtgggcattcaactattctcaattgtcctaaactagataagtggcttattagcatttataacaaccttttcttaaaatgcccctaaatatgtgggaggagaggacctcagggtatagtacctgcttaatgtgggtgaggtgctaggatccactcttatatagaatataaccaaacatgtgtgttcttccatatttcagtcaggtaggactttactatttatgagattataaaagtaaatacttatttttaataagaaacagaacactccaaatttttgtaactgaacatacatttgttttgtgattatgttgttaattgtgaattcatttgcagttactctttcctcttactaaaattcaaatagtttcaagaataaatctgatttttcactggtttgaagtgatggagatttttttgtacaggacgtttgtctattaaaattagacctggatgaaaaaattcatagatgaaattcctttaagccaaactcttatttttcggggtattgctttgtaattgctaaggtatgactaataaagatctgttttaattgttcactttttagagaacctcttcagtctcctgcctcgtaggtgggtgacgtagaactccatgacacaacagagtcagggcaatgtgttgcacgcacattattttttttttttttaatgctactaaaacactcaactgagtcattttctctgaccgttcttccaatgtggaaagaacctaaatcaaagaccatgactgcttttattggcaaacagtagataaatcagggatgtaaaaagggaaacaggattcggcacaaatgagtctcggaatggactctctgggtgaaaggtttattctgccggttttcctcttgagacacttaggtttaaggaaatgtttgcgctgctctagagaaatagtaggttgtatgtttttcctttgtgtttggatcactctggaagtaattccttagggcacagttatctaacatatggcaatgtagaaagagcccgaagcaaaggtcatttggatgtttcagacaggaacgaagaacatccatcttaatacgactcaggaagggtgaaggcgcagcctgtggtcagagggccggcgaaagggaaggggtgcaagtccacacagaaaacaaaactgtggtttttgcttttacttttgtttgtgtttgattttacatgagaactggttgtgtgtgggggggaggaaatctgttggtgatagacaaggagtgaatcagatcatcatgccacctgtacttgtgacctgtattgctgagcaaagcactgaactcagtattcccacaccggaacctattgttgctgtcttaaaactcttaccattttcttttactaagccttattgttgtagctggtcgtgggtctgcaaattactcgacagttctgcaaccatggtctattctaaactttgttcttttagatgaggaaaataaggtcctagaagagaaacgacggtcctgcaaaagcacagccaagaacagatgagtctggcttctctaggtcaaaactgcagctgagatcaagtttaaagggtctaagcaaggagaaatgccttcccacacacactgaaaagaaacttagacagcatcacaaatgagccaaatacagcatttggaagtgagttctgaaggacataactggatttgaagcagacctcatactgatttttttttataggacatgtctaaaaaccataggctctcatattgagtttcctcaggtctggggtctggggatgctggcatttgcccatcgtcgtctcacccaaagaaccctgtggtcaggatctctaagcagaggagcaagttgaatggttctgctagtatctcagacagccaactgtcctactctgttcctgaccactgctgtcccaatgaaaatgggttaatcttgataatggtgtatgttcttcttgcaaagctggaaagaaaactaagaccagccctgtatcagctatgcaacaagtggtattacatgctggaactgaaccttgtggctgcctatggtttccaaatgatcccaaggttcattctcagtacattgtgtccttaggcacagtactgtcaggactcaaagtcctggtggattatacatgaggcaaggcatattgaatagttgcttttacgttttagatgggagtagaaggtctgattttagccactatgtctcagcttactctccataactctctgataataaacaacatttaaaaaaatctattaataagcaagttcgtaactccacacacacacacagcaaactgaaactctgaaggaccagaaaaatccagggaatttttcagatgcatttcttcctatgagaaatctttaactttcagttccctttgtgtaaattagatgactatctaggttgctattagatgattcaggaagaaaaggatatttgaaatagacaaacacacataccaccacactcaaggagactgaaaagcatccgccattttcctgatgtcctgcacacccagtttcgtttgaggaggtggtaaggatctccttggcaagaagagacactcttctgtaaaagagatagtcgggaatttcttacatacctggtgagggtgtagaagggtgaggcatcagatatttgccatgtgagggtcaagtagagagtggaaataatacaaggaagttctcctgagacatttgtcttggcagcattcggtatcacagcatgccggagctgaatacactaatctttcacatgttgtttttgttttggaatcactgtgtagttagcctcatcttgaacttaaggtcctcctgcctcagctttccaaggtcctcctgcctcagctttccaagtactgggtttgtaggcgtgtgccaccacatgcagctaaagtttatagatgaagaaaccaagggctaagcagtctgtgggggttgttggccagttgtaagcaaaagtgggccactagcctctaagtatatttctttcacggaatgtggtgtctgggaaaacgctcactggggaggacttctgtgaatacaaatcagtttgtgttaaacatttgaggcacagtgaccttgacccaggacattagcttttcaaggcgcaatgtctttaagttggcttgggttttggctgttgtgaaaataacagaggactcatccctagtacacatctcaaatgctctacaccttggtcacaaggacaaagatgaaggaggggcagagctgatgactttgagccactcagagaggctaggtcttcatagtcacagacacaacagcagcctaagagagcacaaccaaggcccagccttattcttcagcgttctgcttctgcagctgaacttcctattgacccatggaacctcaagttccttaatatgcttctatttggcatgaaacacagctgaagaggccgagcaaggagcatcaggaaacagctctgatggacttcagcttccttaaggtagtggcttgagaagaattcaggaagacagagaacgctgcccacttacacaaagctagccatcactgctgtgtttctgagggctgcatgttcttcaagttgacttcagaatgaaaacaatgacactagttacaaaaatattgctatgccaggcatggtggcacacacctttaactccagcactgtggaggcagaggcaggcagatttctacatagcaagttccaggtcaatccaaggctacatagtaaaagcctgtctcaaaaataaaacaaaacaccattgtctctggacatagctagttgatctatctatgcacatatatatcaaaggtgtatatgtatagatctatttaaatatatatctttgaaatagttcttaattgatgtatgcctgtaatcctagcatctgggtggttgaagtaggatatccgtgggttgtggggcagcctgggctacacagtgagatcctatcttcaaaaccccaaattttaaaaatgaaattaagctacacatggtaacttgaagaagttaactggacaaagagagttcattctacttattatcaaataatgttcagacccatgaaagctgcttataaaatactttctagctatgtgtatgggtgtttacctactcctaaggttgagctgaagtatcaattgagcccaggaacttgggaccagcctataggcaacatagcaagatcctatctcaaagaaaaatataattaatacatgttaataaaaatgttcctcaaggcatatgtcttaggattttcattgctgtgaagagacaccatgagcatgacaactcttataaaggaaaacatttaattggagctggcttacagttcaggggtttagtccattatcatcatggcaggaagcatgacaaacatggctataatcaaaaataacttggggagaaaagggcttatttcatcttacactttcagtaaacagtcactgagggagtcagggcaggaactcaagcaagacaggaacctggaggcatgaactgaagcagaggccatagagggatgctgtttactggcttgctgtccatagcttgcccattctgcttccttaaacaacccagaaaaactagcccaggagtggcaccatccacaatgggctgggccctctcaaatcaatcactaattaagaaaacaccctcacagacttgcctacagcccaattatttggggagaagttttcttaattgcagttctctctgctctggacggcaactctagcttctgtcaggctgacaaagaaaacaaaacaaacctaccaatagccataaagagaccaccagcagcaaactaaccaggaccgggaggcttagccttgatggaggaagagcatccctgggggtgggatatgaaagtgaaaatcatcacctagttctaattgctctctgagctccatgctttcacttaaagagatgagctctcagcttcctgctcctgttgccatgcctcctagatgtgatggacacacatccctctggaactgtaagcccaaataaactgttttctgtagttgcttttgtcatgatgttttatcacagtaacagaaaaagcaactagtacacctgcccacatacaaagcccgctctcaagggctgctttttacggaatctgaggctaacacaataataataacaataattcctgtactggcctcttctcacccctgattaggcagtttctcccactttctttcccaactctgacatcctgtgtggcttccagcaactaatttatccctgacttcaacctgtttttctcattgaagcctacagtactgatgtcctaaatcccttacaatcctcaggtataaaaatgccttgattctatttcccctgagtccaaatgctccctaatttcagtggccataagccctggataaggtgagcccagcactgcatctttaattaggtactccccaaatcccttgtggtatgtacagtttggtttagtaagttatatcaagggcattttatgtgagggggatggagtgtgaggattattaaaccatggtttctaaatagctttggatgtcttgaatgaaaagtgtttttcaaatatatggcagtgcttttagtaacagacattgccttagcccacagaataatttttctttgggggaaatgcctcctctagctaagcctgggtagactgaacatgctgtagcaattccatacttgacagcctgggctgctacaatttatccacccattgattcagaaacaatcctagatatttatcaggtgccaggaactctgctagatcctatagattaagaaacaccctctcacctctgggttgctaacatctgcaggtgggggtggagtggttctgggaggaaataaacaagtgagctgcagataactggtgaaggaggaggcaaagtgctggggaagtctggaagaaagcagctcagatcctggtcgatgtcacaagttgtcataggggatgcatttagatgaagcttggaggggagcagaaattttatggtttttttgtgctttttttgagagagagagagaaagaacatgaagttgggtgagtagggaggtaaataaaacaagtataattttattagtttatactcctcctaggggcagaatttggggaggggaaagaatatgatcaaaatacattatacggaattcttcagtaaataaaaacaaaacaaattcaaaaggaaaaaaatggattacatttagataaatagcagcttataaaactttatagaggacaccacatatcccctaatttaatgtgtgtgtgtgtgtgtgtgtgtgtgtgtgtgtgtgtgtgttgtttgtttgttttcttgatttattttttaagatagggtctcacacagctagccttaaactcaccaggagtgaagggtcaccttgaactcctgattctcttgcctcaacctcccacgtgctgggattacaggcacagcattgtgtttggcttaatcccaccccatcccccattcttaacattttacattttcatggtgcatttgtcaaaacaaagaattcaactttggctcagtttataaagtgcactctataaccctttttaaattacctctattttgatattttgtatgcatgggtgttttgtctgcctgtatgtctgtgcaccacatatgttcctggtgtttccgaatgccagaagagggcagaagatcccttggtgctgcacttgcagaaggttgtaagctgcccgtgggtactgagaattgaacctggtcctctggaagagcagccagtgctgttaactgcggatttctccatcctctattagctttttcagtgtcaccagttttcctagcaatgtcccttcactgttcttggatccagttaaggcaaccacaccttcattgttgtggctctttagtctctggtctgtgacaatttttgtcttagtttatctccatgctgctgactatcttgagagccagacatgttgtaaaatgttcctccctctagggttgtctgctgttggagaagagcattgcagaggagaactgtcattcttagaccatgtcaggggccccatagcccacgaacatcactggagatactgggttgaaaggtttatgtataaggtgtagggatacacagggggcttggtggcagtgaaaagtccagtgaacctacaggtggggtgctggaaagggagtggtgacaggaaagccatgtgttggtagtgcttgtattttcataaaagattttgtgggaattgtttctttcaaagcttagcagtacatggtattatgtatcatattatggggaatattgtggtccttgttaaaagatgaggaaagaggctcaaaccgatgaagggaaggcagaaggtcacacaaatagttgcaaagccaggccttacacacagccctcctgattctgaccacagtgttctttgctcattatcctggtcactgcaaggggatgatgggacagtgtatatgtcatggccgaaaccttatgctctctcccaacattttagctaaaccgtactcagtaaagctgggcaaagtgaagccagttcctagtctgaagacatgaaaacctgcgcagggctggggacatttccttctttctgtgttgctactcaccacgaatcttgcacttatgtcctgaaaggaatataccactgtgcctctgagtgtggcactgtttgtcactcccagcagcaagagctcctggtgtattctaccagcaatcaagacagatcaacatactctttggacagagagctaactgcacacttagttgacccagatacagatttcatcaaggacagtttgaaaagagagtgagcagtttctcactccttcttctctaacaagctatgagattttaccatggcagaaaggaagccccaagttggtgaatcataagttctcatatatcaccttctttggatcttacactcattggctcatttcacaaacacgtcacagaaacacccatgtgttacataatacaaaggtaaggaaaaatatcagtaaatcattttgtttctgagaagctcaccagtagaaaaaccagcaagaaataaaacaaaatcaaacaaacaagagcctctgtgagctttaaggaagggacgatgggtgctggagctgggtgtgtgggacagcaaagggcttgggatagccagcacatgtaatggctagaggagagaggaagagtgtaagctactgtttcattgctgtgataaaacaccataaccaaaaggagcttatagaagcaagagttaattttggtttagagttccagagagttagagtccatgatgataggaagacattggagcaaactggatggaggagctgagagctcacatcaccatctccaaacccaaagccgggagagcaaacgacgtagagcaagaccttaaagcctcaaagtcggctcccagtgacatacttccctatccaggacacacttcctcaatcttcccaaacagcaccaccagcaggtgttcaaatgcctaaggttacgggcaagcaactttttgggatgcaacactgctgggtcttctgaaggggaacgactggtgttgctggagcatggtgagggtgttgggacagtgagaggcagcacagggcaacctaactctgactctagccctgcatctgggagtggatggagacttccaaggggaggtcctccagcctcctcccttcttcactgccatccatcagccagctagcaatttggatcttcctacttgatcttggaagtacaaaccctttgtatgtgttgatagaataatagcatttggcttgagatgggtaacagactctcttgcaagccaactttgcatagctccaggctgagtagaaacatcctactgtccttaatgtagtcttcctgtacaacttttattatcctgtgtcacgtggcttctctatagtccccaaagctgctaaatgctttaaaaaggccaggatttttccagctctgatctcattagatgtacaaattccaagagcagcctcccagaaaatagaaggttttttcaaatttatttttttataaaacagagtggatgtgtgcatgaaagatacattgtttattttcttggcacagacttaactctaaaatgagattacttaattggagcaaacatttcctgacatgctgagaaggagtatttgaaccaaatctcctctcttagattcagtcttgggtgggtgtgttttaggctgtttaaaccatgcaaatctcaaacgcaatctctcttactaccgaggcattcagttggtaaggcagaatgtaactggatacaggcggcaacagcttgtgatcaattatgggaaagttcctggatttgttgttacagtagtagtttatttatttatttatttatgggcacagagcatattaaatctggaagcattcagtcaaattttttatagcacaggtctgttcctaactttggtgtgcagagtaccacaactcactttcactggtcttttgagctatttttttagacttggtgtcagtattacagtatgcaataatatatatattatgcatatgtaatatgtattcttatgatatatagactaactttaattctgtaaatattctacaatagaatgttatatataattatatgcagctgcatgatctatatgatttactattttatataataatatttatactagtaaaactagtctcagggcttcagagatgctcagtggttaagaacacttgctgttcatgcagaggacctgggttcagttccaagccagcttacaaccacttgtaactccagttccaggggatcaatgccctctatttgtctctctctctcttttttttaaagaatttatttatttattatgtatacaacattctgcttccatgtatatctgcacaccagaagagggcaccagatctcataacggatggttgtgagccaccatgtggttgctgggaggaattgaactcaggacctctggaagagcagccagtgctcttaacctctgagccatctctccagcccttctatttgtctttttaagcacctgtatctccatggtgcacattcatacactcctgcacacatacttacacattaaaaaaacccagtctgtctacttacatatatgtggtagtttgaatgtaattggtccccataatctcatggggagtggccctattaggaggtgtggctttgttggagtgggaatggccttgttggaggaagtgtgtcattgtgggggtgggctttgaagtttcctgtctcagttgacttcctgttgcctgcaagatgtaggactctcagctccagcaccatgtctgcctgcacactgccatgatgataatggactgaaccgctgaaactgtgaaccactctttattaaatgttttcctttataaaagtttcatggctatgttgtctctttacagcaatagaaaaccttaactaagatgatatatgtgtaaatatttttatatagtaagtatacatacatacatacatacatacatacataatacatacacacatatcctagaggtagctagcctttgttcctgggtgggacaaggaggtggctacctcatgagaacttatttctaagtttttccttgaatcaggtaaagcactatgataatttttacctccagaatgtgaatgacatgtcactccaagaactgggtttggatttggggctgccctctacagacctcttgcctctttgagttggctgaaatgtaggcatggagattcagttttgactagctgggtaacggcagcaccctaggatactattacaacatagggaagggaacttgggcagagtgtctttggctacctgggttgtttacctccaaactgtgtgaagaaaataaattccttagtttgctaagccacattatcagacagggttcaatcagaaagccaaatcatagggctgggcttatagctcagttggtagagtgcttttgcctggcacgcacaaggtccctatttctgcagccatatttgctatgaaatgaattctttgatcagaagcaatgctgtgtagattggcacagagtggctatgacattctctaaggcacacatagtcacttagaagcattataagaaggaagacaagaagggcgagcatccgttctaataagaacaaagtgctgttacagaaacagcccaatgtaatcaaccagcaagtagctggctgacctctctgggagctgtgccaatgtaggagctcaaagactgggcagattaggcactcagtggtggttttagctgcatcaaccctgatgagtggaagtctaagtacagagcccatgcagaatttccatccttgcctccatggtcacattgttcatgagctcactgggtaacgataaaggtggatatagaaggagagtggctgagcaggccagcctacccacctgatccactctcccgtgagcattcacatatatccttcatgcccattcagaaatgcatattcatggacctttacctatatctcctaattatcagttttcagtcaacttcccaggaccctgatcactagccaagttactactcacagagatggccagcagctaagatgccactcatagcttgactctacaaagattatccctgtgaccattcttccttctagatgagacaagtgataatgagttgatatctgacctaggagacacagtcatgtctgtttcccaaatgattctactacattactgggaaactttgcagcttatctttagttcatagacactgatccttgaatgctatagcatgtatgattctactccagcagccttctatctggccacagacatttcaccaatattttttagtaagtggatggatgtggtacttgaccataatactgcagagactttctgaggacaatcaaatgtaggaaaagtctctacatctgcccagcatctgagattgcacaacacataaacactgagaatcactctgctgagtatgtgctgaacatctttagaaaatgtggatatgtgtgtgcttgcatatatgcagaagcccaggggtgtcagcagacaagatcagatccccttaaatttgagttacaggcagttgtgggctgctatgtgggtgtggggaactgaacccaggtcctctgcaagagcagcaagtgttcttaactgctaagccatctctccagctcttacagtaacttgtaaaatactaattgtgggactacataaattttaaagagcatgacatcaattgtgtgacattaagtttatttcttgtcttggttgaacatatatgtgtatccaagcctggagagttatagctactgccacagaagtgctcacaatgggcagagaaatgtcttgtttattaataattatgtctctagattgctgaatcaatctgttcttaagtgctttgaggccaaagcccattccaacactggacttgttttatactctcttcagatttctttggtgtttggcacatgatactaatttataaataatacccagagaatgaaggagctgtttatcaagatcatgtcaaacactagtaacttactgagatgtctcacgttgctgaccagacagagtggcatctgtttagaaagacctgggctggggccaggaaagctaagttcttgctttagctttgcctctgcctgcctatgtgaccttgggtaaggcctgcatttttgatggactttgattttctgatctgaggatatttgggaattgaacagcagccatgggaggcccttggaccccaggggtgttttatttagagggcacaatgttctaaacaaaacaaaacaaaacaaaaaacccaacagtatttgggggtgtggatatagttcattggacagcacttccctagcctgcacagagccctgtgttgaatgctcagtaccacataaaccaagtgtggttgtgcatgactgttatttcagtacttggatgcagagtcaagaggatcagaaatttaaagtcaccatcagctaaaactcagttgaagattagcatggctacctgggaccctgtctcaaatcaaacaaatgaacaaaccaaaccaaaccaaaatactcctatatttcgatgcatttggccacgtgtactttctgatttgctagagttttcacttcttcctcacatctttggatatttgagtcctaatctggcccctggagccacctgaccttataacctctgaatatgacactcttcagtattgacattgtccatgttcaagccagggcaggaatgggaggctgctttatgatgctggatacacagtcccagaatggggtctggaacgcaatggatgcttgttgaatgaatgaacaaatggataaatgaataaatgaataaaggaaaattctaccaaagcagaccttatggaaagggatgtgggggaccatattgggagacttctctctaaactagcaaagttgtttctctttctgcatttgagattgagtaggaacatctcttgtcttctccaacctctcaaggtccctaggggaaatgacatcactgtaaagattccatcttcagttgaaacagctttgtttaagcactaactgccaggaaccaaaaggatttcctatgcaaaactgaccgccttgtgtagtcctcagtcctgtagacactgctcagtgtcctcagctgagtttgtgccctgtcttctgggaaacttaatatcagctactgcaggacacagctgaggaactcctggaaagcgtcccttacggatgttaatttctttttctttttgagaatacagacccacagcattgaagctaactcccaatacaactttcttctttctggaagctgttaaacattaacattagattacatacatgtcagcagaatatcccacacaggcctctccctcagcaccagtgaatcccccagtgcatctcctctggggggcaggggtaaagaagaattggctcacttttatagccacggtgggaggagtttctgaagttgtaccttagtccattagaaacaggactaagccacatcacactgcctcttggacaagtggacaagaccagctaggactagagactcgaagagactgattcaatttccaaagttaactagaaattaatgttgaattcatcaatatttaggctatcaccttagatttttctgactccatttatttgctgtataaatcttcattttggaggttaatagtgtaacttgatgaattttgttcgacaaacccaggaagggaaaccctacatagagagggctgagccaagttttctccatagccgtatatacctatcatctcagcattcaggagatggaggcaggaggatcatgagtttgaggctagcctgggctacccaaagacaccctgtcaatgaagagagaggagatggagggaggaaggaagggacagaagaaaaggaacaatggaggccatggcctggaagctgaggcctgggtctgaacttcactcctcttggtagagtgacatttcatttacaatgtggacatagggacaagggctagatctggtctgtaccctcagaggccacagtggtactgtctgagaatgctcagtggggactggcatctctccccagacatgcagaagaggcccttgttttccctgggctagttctgtttcactggaaatatcccagcccaagtttctgcttttcatttcccctgtgtttgtggacagagaagccaggtgctttcactctgctgtggctgcccatcagggtacacagttgggggagccttgggaaggtaaacaagtgggggaatctgggcctgggaggtcgcagttttgcctttacaaattaggctgagctagcacaggaccatgtcgtgtctccgtaaagggtgagtctggacggaaaactgctaaatagccaagtgaagtttatttctgcatcactggcttgcattacgtattgattatctcatcgcctgattaaaaataaatacgtgaaaattccttttaacagagaagggggaatagcaagcttctgacttgagacagaagtgaatcatgtaaaaggttatcacatggtgaccttgaggacagtgaaagaagctagggggctggtttggaagaccaatcctctaacattttaaacaggaatagcctgcttcgttacagagttgacgcctgatgacatcacttccaaaatttagtacgtgtacaaactcacagttttctctggtgcagccaccttcgttatctccaaagtgaacaaaggtcattaggatctaattgtacttgtaagtgcttttgtttggggtactttctcatcaccctgaaaagagttcgagaactgtaactttctgccctgccaatgaattagcctcagcttggggcattctaagaagtttcatgatgagtgaggaaatcatgacgaccacatgtcaagctagaactaaaacaaatggatgtaggtcacgacctgtgatgaggtcatttttttttttttttttttttttttttttttttttaccatgcatgcctacagcgagggttgtgtataacttatatgaagacaggacactcctctctaccccttgcctcttccaccttcactctctgaagatgaatctacccagtttttccaactggttatcttggtatttatgtcctgctatggagggacataatttagatgttaagagctctgtcttcagtgtagcagtgtagcgagatgatgcggacctgttaataggtgggtcctagtgtgaagtagttactgaggtcactgctctaggaaggactagatatagctctagtagggcttaggtaattcatgatagagggttgctgcaaaagagtgaaccagcacgtgatcacaccctatcctgccgtgatgccacccattataaggtgatgcaaacaggcaagccccttgctgtagctgtttagactcaaactgtgagctgtagagatctcttccccaccccatccccccaaactgtgcagcttcagatatttagttacagcaatggaaagtgtattaatgtagaaacatgtttctaaatctcaggcttttactgctaatccttgaatttatacttttaaatatcatctgtgatatttcaccataaaaataaagatccccttagcactgtcccactcacattcccaggattcagcactgccccaccctgcaatcctgaaacagattacattcagttgtatggatgtatatggtcccatttaatgcccatttagaagctattgacaacggaactgtgtggtctattcagattgattttcttattttttattctctctctctctctgtgtgtgtgtgtctctgtctctgtctctctctctctctctctgtgtgtgtgtgtctctgtctctgtctctctctctctctctctgtgtgtgtgtgtgtgtgtgtgtgtgtgttaggatacatgtaccttgtgagtgtgtggaggtcagaggataactctggggttctcccctcccacctttacatgggttccagtgatggagctcaggtcaccagtctccctggcctcttttcccatttgaaagtcccacatggctatctgatatcttgagttccatgccctgggcatttattaagctgacatgttccagtaatatctttagctcccagggttaagacccagatttattgtttagatgagtcacataaaaagctcccagagtccccttctctggccatggtgtgctagcacgatcctttattttaaaggtgttctcttctcttagccctcaggcagggctattcgctcttccttccttccttccttccttccttccttccttctttccttccttccttccttttttttctttcagttttttttttgagacagggtttctctgtattgctttggaggctgtcctggaacttgttcagtagaccaggctggctttgaactcacagagatccgcctgcctctgcctcctgagtgctgggattaaaggcatgcgccaccagttcccaactatgtgttatttctaatcagacagatttatattactcagtccattagagctgaagggcccaggatttgaattgactccttggtggtgagagagctttgctggggaagggctcaagtctggacattggtaagctccacagatatgtgcccggggctccatccagccccacactcgggcaagctgctttcagtgccaaccacattttctgcatgtgtgtttctatgtaattttcttcatgtgtgtgtttctatgccattttcttcatgtgtgtgtttctatgccattttctgcatgtgtgtgtctatatgtcattttctgcatgtgtgtttatatgccatttttaagcaatactttgcagcttttcttaggagacccacaaccagaaatggaggaaaccacacaggccagaacaaaaggacactcgaggtactgtttggagaacacgtggaagatgttagaaaccacaacatcccacacctgtagcaacacaacatcaactacagatgtgtgtgcactctggagcccattttagactcaaatgtatattgcttctaagaaacaaagccaggctgtgtttgttcgggcccttccagcagatgcctgaccaggcagaggttgtgcctctgtagcgaagagaagacttcatcttcgagggttactgtaactaaagtcaaggtcatcaatgacctactgttagcgcagttttggcccaggaggttcttcttgttcattcaaagtgaacagaaagcccaagcaacccaaaggacttaggaaggcaaacagcagctgcccccaccccccatcactcactccttactgtctgaaagtataacctgtagcctctgaattagttctatgagaaagaaattttaattctgtcagttttaactccctcccaatggtatcttctaaaagtggatccagggcccagggagggagctggagtttggttaggcaacaggaaactttccattgacgatccgagtaccttatcaacagattttatctttgttagcttcctatataaaccccagccataaacaccataaccatgagcagtttcactgttcagaatatatgaatgttctcaagattgatggctatctacaatcttgggtcagatccaaggccataaactcctgtgtgttatgagaagcagaagtgggcatggaggccgtgtgtgtgggtgttgtataacaccttaggaagccttttagctgggggcttttgtttccatttttgttttattctgtgttgattcccagggtctttctgctgaagacagctatgaagacatggacatggataatgcttggtgagagagatgctaaatgctctcctattttgctcctggagtaccttgaagcactgacagggctgtgagacaattagcttctgaaatggcacactccctgttctgttcagagggcttgagaggcccatatatcttctttgaaatgcacaaagtgataaataaatcaaggtgacttttgcctgtgaggttaaagagaagtgtcttcagttaccaagtctattaggttatatactgctctgtaacagtccaccctcaaactgaactttagaacaataaacattcgttatcacactgtttctatgggacaggaattcagaagggatctagctggctggttaggcttcaagagctggctcagagtgtgtacttctaagacgactcccatacatgttgtcaagagattgcagtttcttggcacatggggcactttccctgggcttcttcagtatgcatgacacaaagactgacttcttccagagtaagtgagccaaaagaaagcaagtagaagccactgggtcttttatagcctaaacttgggagtcacacattgttatttgcacaatagcctgttatttatataattcagctatacaccacagtggacaccataaaagtggggataccagagtgaccccctaggagcaatgtcaagggttggctaccacaaatctgaacaatactgacaaagaatgaagtgagctacaagtggttttgaagtacgggtctaagatcagcatgactttgaatgctttgaatatttgtttatgtgccctcagcttaggttggtgcccattatctgtccaaggtcactggacaggctctgagtgtagaattggcattaaatgtctgctgttctggagagagtggtgagtataatactggcctattccacttagttgttcgagcctacatttcttgtacatgtgaaataatatagttacttcacaggcttcctgtaactgcaaactaagaaaccatagatagcacctaagcacccagacactggtaagtgttttataaattctgattgcttttgccactgatgtcagcttgagagatgaacacggtacacaggctttgaatgctggctctcatgtaacaagacctttagatgttggccagttttagatttgattaatgcaatggtttgatccttagtaagtgcccaggttcttctcatctttcttctctgccattttttgtattctcccctcagggctgtaaaataggtgcagcaatcgaagcatcagtgtcctcatgtgcatcactacagccaaataaataccttagtcccgtgtgtgtgtgtgtgtgtgtgtgtgtgtgtgtgtgtgtgtgtggggaggtcacgtatacttgtgtgggtgcatggacatttggaggccagagggcaaccttgggtgtcattccttttctcatcttcacaaagatttcctctttatttcttgagacattgtttcttactggcctcagactcaccaacagttaggctggatggctggccagtgagtcttaaaagagctccctgtctctgcctccccagtgctgagattgcctctacccatgacctttttgcttgtgtgctggggaccaaactccttgtacttttaagggtccttgtacttcaaggcaaacactttatatactgataatctccctagttcccacactgcctcctttaaagtgtaaaagcatcttcctgtattctagtagatgttcccatatttgattaatcctagccaagttaaatgcctgtttctaacccaatcattggcaagaaagaagtggggaatcaccagttactgacttagattaattgaagctattccttatgcttgaagaaaggcatggcttcctagaagcatatgtctgtgtgagacaggagtttgtgggtgagtatggtagcccagcaatatattacagggtatgaggaagataaaatgttgtgcatgtgaaaaatgtctgtattctgagtgtgtgcttaaagcatactttagctggatatagaattctagactgaaaagaattttgccttaacacttaaagatactgctctattttgcttttattcctagtgatatttttgagaagtaattatgattcttaatttttgatatggtagaccagatctcttcctgcaagtgtttttgaagtatgattaatttatgaattcctgaaatttttgttgttgtgttgggtaagcctcattcttagtgttgggcacttatttgtccatctagtttaacactacatcccagcgagttctgggggaatttctttaaaaagcaaattattttcttcactttccttgtagaactcaattaactgctctatctcttgtatttattgtcaagctttctttggggggggtgctttccattttttgttgtttcctcaaacatttcttcaatttcagtttttttttttttttaaagatttattatgcatgcagtattttgcctgcatgtatctctgcaggccagaagggggcacaagatctcattgtagatggttgtgagccagcctgtggttgctgggaattgaactcaggacctctggaagagcagttagtgctcttaacctctgagacatctcatcagctctcaactttagttttcacactctcactgaattcatgtctagttcatacttttaatttctgaattttttttctttattttacaaagtttcttttgtggacatccttcttaatttatgagatgataccttttctcattcccccaaagattttgcctagaaggccatttctctctgcttccccagatttttatttttccatattgacttttgtcttttgttagtgacttttcttaaaatattttgtgattcttcgttttctcgtatccaagtacatatgtacttttacctgtttgctacctattagttgtgaacaaaaaggaataaccaaagtctcacaatatgatatcatacccagatgaaactcaggcaatcattgccaatatttattaagtgtgtattctttgttgaacaccaataactatggtacaagttacaactgagaaaacagaggcttacagtgttatgtaacctatccaggaccatagagccagagtgaatgtgaattattagttacaaggttgcactgcctcttactaggtgaatgttgtccttggcagcggccttaatttattctttctgtatctcaccattctcttggtcccagcagaaataatttagagataacttgtagtgaagcaggaactaatgacaaagaaagaagtagaaacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatttgtgtggaggtgttttgcttgcatgtatatctgtgccccatatgctgcagtacctgtagaatccagaagagggcataagattcccctggaattaggagttacagacagttgtgagcggccatgtgggtgctgggaatcagccatgtgggtgctgtgaatcaaacccgggtcctctggaagaacagccagtgctcttagccactgaaccatctctccaaccccaacatttactggagttttaaaggggactatgttgattcaagtgaaccatggaatccacaaagataacattcctttatctgattttgtgctgtaagacactggcattagccttgctgactgtctcttgagagtttcagtttcagctgaggggcagattgcttagcagaggctacatatagtttggatcttctaagtaccctgtgttccacatgttagcagtgtgcttcccagacattaatattattgggaaacagtgagactttggggaggtggggtctagtgggaggaagttggttattgggtgcacctttggaggggatcatgggaccagggctggttttctttacctcccaactgccatgaggtgagcattttccttccctgtaaggctcccactatgatgcacctcttgtctatagggcacaaggcagagctcaaataaacttactatcctttttttaagttgtttatctttggtacttgatgaaagataattataacatgctaaagtttactcatggagataatcagctccttaaaggtttgccaacctgaaatcatagaacaacttgaccttggaggactctacgattttacagggaggtggaggccccgggaaggcagacatagggtagttcaggctgtgcatggaccagtgggacccagacaagggaaactgagcagtagggtggggccccatgaaagctgatggtggctgtcactagaagagctggcctccacttttaaaaggtccttgaggcaaggacacaagagtgacacatgaatcagtcaacagtcaggtcagttcctcccagttcttaaaatttggaattctcattggctggcaaagcaacaggaagaggggggtttgtttctgtttacaaagaactgctctaatttttccagtgttttcaaaagaaagtgtttgctttcaatatatttgaaaatctggaaggcgtacactataagtcagtgcatgaagcattatcaactttaaggttagtcattgttttcttgaacacaattccccgtgtttaaagagcagaaagaaagcagagtcgttgtcagcactgggaaagtcagaggtaagtaggagccagcaggtccgattttattcaaaacacacatcaaatcctattccaacttatctttgactctcagaccttcccctagatttgagctgtcttctcggggtatccttcttctagaggtttgcttctgaaaggagctaagagacccctgttctagttgggcacacagtgatggtcatatcccaggttttctgtagctagaaaaaaatgtggccctagaaacataaacttaagtcccaacgctggtgacccagaagatgtatgtaaaacccacagtccagacacgctattaagcatgcctccttgtcttgcagggatgttggagtggagtctgagttagttaccacaggataaatgcatttctcatacaaaacaggcttgcctgatccaggctggttccctccggagacaagagggtgactggcagtggagggtgaacccacgagatcctcaactttcctgggttcctgggactggccagcggggaactaaggacactagctgcttccactcgcgtgcacgagcctcgcgagctgtccccggctcattttccactccgctgcttggctggccggaccgtaaacccaacctgacatggactcattaatttggcagcgactggaaagctgggccatagcggcacagccgggaggcctttgtggacccggggtcaggtcagagggcaaccgaaacaaggctgagccctgcacgctgctgctccaggggctggactcccggcctcctgccgcattgctcctgctcgccttccggagccaggaaccccgcgacccagccgggtgcttcctcctcacccagtaccggagtcttagccgcatccaggtcgcctgctgtcttcaagatgcagactctggggtgcagccacccagggcggatatgaagatgcgcgcttgcagtgacgtggtgatgcgcaggtgcaagcctctcctcggtgccacctggagctctggggcagcttctttggacgcgaagcatctacatttcctcgggtttagtctcttgcatggtctctcacacatgcctgcgcctaggtagcgggcaacaggctgggggctagaggcctgttccttgttttacaagtggctccagcacagattaatttttagcaattttggaaaaaaacatagcggcctccttctgagcctttaggtgactcttgtgacatttagcagcaaagagaactatttcctctgccattcagagctaaccacgtttaattggcccagaagtctgttgtattttgggaaactgtttgcgatatcccatctgttttcatcttggggttcaaacgagtctgtgtttacccttctgctggggaaattggtttacatgcgcagcaatttcggtggacaccgagatattcccttgaactaatgctgtgggtccgacaggctttgtaccgctaatgaccctccattacgtctgtcaggagacatttacacagctccacggtcagttccataaaggaaattaagaccttaggtttatcataactatttgtaaaccaactggtcttccacgatggccagaaagctgtagggccacaagggcaaagtctccgcggatcagccatctctaactaaggccttcagccctgctgatgtggcctttgtgcccccaaactctcccccctgattcatgagtgatcctagagctgtggcctggctcctcaagtgacagataaagaaagattccacgtattgctgacctggtgtatttcaaagactaataattgactggggcatgggtagttcaggtatggtcctgtgatctctaggaccgcaggaaggtcatcactctcccaagaggcatgactcttgctcctggactgagggcacagaaaatggccaggtcaaggatgtgtgaggagccagcatgacggaaatgctgtgaagggtgctttgtttcagggtgggcagacaggtctggaaagtggctgcacaggaggctccttgcacccctgtgaggccctccggttgtgtaatctgagaaattgctcccaaatcacttcgtatgccctggctgagaggtccacaatcaggctctggcaagtgtgcaaatgctcattatgtgggtgttacctcatctaccctgcagtgacaagcctggcttgtggcaggcaggctgcactcattgcctggcttgtggcaggcagggcttatcctggcatgagagggcagatgctgagatggggtgggataaagggtattaaccagggggcccaaggactgggaatacaaaacagtatagaaacgaagatgttggaagtcatgcctatagcttggatgccagatcattgtctctggtagaaatgaaccactctttctgattacttgatcccccccccccgccccatctttctcttgaggagaaaaggagtagaacaaatccagggtgattaactcaggatacaaaaggatcaaggctgccttgacattcagaggcctggagaggtgtaaaaatgtgtgtaaaaatgcctgctctcaggcctggtggcctgagtccccactgggaacccaggtaaggtagaaggagagaagaccacaaagttgtcatctggtttccacatgcacacccctgtcccagaattgtgcacacataatagtaatactgtaaatactagtttaaaattttaaatacaatgcaagatccactccagcagacttctcatagcttggtgagaaactgtcatttgcttagaactctatatctgacaatgaagatgtgtgttctgcctcataggaactctctctcatttgtttggagagaaaatgatgtaaaagacttgggatatttgttgcaggaggctggacctccatactattactataagaacaagtggggcagtttcaggctgttcacccaaatagacacatgaagaaaggcacagggctggaaggtggttttcaggccatgcaggagaggaaccagagggagaggttggaaagccgtgaggacccagattaactcttgtttctttccccacctctgctcctacagtgggcaatgcaaaacacctgagctccctgtgcattgtcttgactgttcttcgttcactgagattggagagccccatttctggctattaacccagctcccactcttgtctcaatacgacacacacacacacacacacacacacacacacatctcttcttgatttgattattgctgagagaatgcagtgtcctgtaaatggtcacagtcctgtcagtcctaaaggtggcaaatgcttgatctttgaatgccttttcctagtgaaaagtttctagaccctgataagcctctcagccggccgatgcagaaatccaaatcagaccaaatcaaaccaaattagaaaaagccgagtttaatgaatacaattctcctggatggccttccagccctcccctagaggagtcaggaaagggagaccagaaaaaccacctgtctgttctctgggggacagtttaaataccctgtgggagtggccttgagtatctcttggggagggtcatcatttggcaagctttctgagctgcaaccggtttggagggagatggaggagggggcttagatggaacttccaccataacatcccagaatctgtgggtatatggatgccaggggctggggtgaaacttccacttttacatgccagactctttggttcatgtctggcttcttcctgctgacaagggaggatgtcagggaagggggagtcagaagtcagtgcgatcatgctctatggtatgagtgaccagacctccatactattactataagaacaagtggggcagtttcaggctgttcacccaaatagactcatgaagaaaggcacagggctggaaggtggttttcaggccatgcaggagaggaaccagagggagaggttggaaagccgtgaggacccagattaactcttgtttctttccccacctctgctcctacagtgggcaatgcaaaacacctgagctccctgtgcatcgtcttaactgttctttggttagctggcatcctgtagacctcggacacctgttctttgaggaggcagagaaggaaggctgctaggagaaaaaatagattgttatcattggccctatgaatgtgactagccacaggagggtgataacagccagaacaaagggaatggaaaagcacatttttgctttttgtttgttctttaagacagattgttgctatgcagcactgactggtcttgaacttgaggtcttctggactcaacctcctgagcactgggattatagtgtacactaccaggccttgcttcagatttgcttttagtgttattgcttttaatatttgtcattgcagtgcacccaacagctagcctgaagaagataaagaaaattgtgagatccttctaggccttttaccagtctgtgcctacgttgtcttgaagatttgtttgagatgtgtctatgaaagagaaatgatagagaaagagaggatggaataaatagatagtccttggcttttaattttcataaatcaaaaggaaatgaaaaataaatacatggggctggagagatggctcaatggttaagagcacttccttcctttgcagaggacccaagttctattgccagcattcatatggcagctcacaccagtctataactccatttccagcggatctggcacttgctttggcctcctcaaacaccaggcatactcacagtgcacttacatacattcaggcaaaataccaatacatatataaaataaacatgaagaaagaagaaaatcagagttcatagggttaagtttttaattgattaaaataatctattcttaatgtgcctgtaggtccagagtgctatcactactgttgtaagggacagcaaaggaggaattttccaaaatgttgcagtttcccccaccccagaggttcctctgaaaacaccttccctggggagtgcacttgaactcagcagggagcagagaacccttaaacattcccctttgttagtccatgattcaaacaaaggctgtggcatttttccacagctgggcagagcagaaatggactgggcaaatggtcccaagctaagccctgaattcccggattgcagattgcgaggcctttaatttatacctctgtgtagctttgctattgacatttattagccgagagtgtggctgccaacaccagtttggagtagattgtggtaaaaacatatttcctctttacacattctaacccagtgcggaaggactgtttttattgaaaccgtatctcaactccaacctctccatactcacagacacacatgtacagagtttaagttatatttatggttggtaaatgttctaattatggggctgcgtgtgttcagagaggaaaattaaatcagtgagcatgggaggtcatgccgcccttccgctctagtttgggctccttatggttttcagctttgagaaatcaatgccgtgaaatggtgggtgacaagccaagcagacatttgtctcctggttgatttacaatgttatctgcagattgttgttggtttttttttttccccttgatgaggtgaatttttgattctttactgcctgcttcccttaacacatcacagagcaatttctaacaagcatctttcctggataatgtcccaggccttgctttccatatgaggacacaagaaatgctgaagtagagatggatgtcattgacactatgcccaatgctcagtcccaggctgctgccatgaggatgatgagtagacaccagtcctcagagtacctgcccttctctgagacagaacagaagttctgatgtcctttacagtgtctctaaagaacaaagtcttagggctgggttagggtggggtgcctcagtcagtaaagtgtgtgctttgcaagagcacagacctaagttagtccctagaacccatgaacaaatgtagtgcaagctcacagtcagcgcaaggaaggaagagacaggaggatcttgggctgtttgtctaaattcatgagttccaggacagtaaaggacactgtctcaaaaaaggtggacagcagccctgaggatgacacatgacgttgtcctctggcctttacacacaggtgccagtcatcatgtacatgcacacatatgtataagtgcattctctcaagcttgtgcacacactggagaaaaaaaagaatgagttggagctacaggcgattaaagggtctaaaggggtttgacaaggctgttattgtccctgtactgttagctcaaagagattataatattcaaaaatgggcacaatctacccaggtcttctctaccacaataaatttgctgctacaggcacaatgccttgtagtgtgggtttgagttgacagatcactgagggcaagttcgtccatactctccagttattcagctcatttatgaatgccacacagccttccatgcaaagtgtgtggtgtagacctggcaccctccacagactgatctctttgctgacagttaagagtagaggcatctgtggtgacccaatggatgtcttgagttgaattcagatattgagttgattaatattggagtcagcactgccagcagccaggacatgtgagtgctgatccccaggaagcagtcctggtggttgtgacatcagtgaccagtgacctatctatagatactaagcgaactgtctatagatactaaacaggtaccaggactctataagcttggtggaagtcccagaagatcctgcaggatgcaatcttccaaacagaaaactggtttgctattttttcatgtttcctaacccaggggctgtttttaaaacgtgggaatttcttaactgagaaatgcaacccgggaaggaaccaggagaaaacctcttatacagtgttaggacctgactaggttataaaaaacatagaaaagagtagagtgataaatcaacatacttcgtacttctacagtgcttttgatggtccaaaatacaaccagaatttttgtttctcgctttcatctcagatctccatgaagacagttgatcccataaaacatacagtgtgtataccttgaagccctcatggatataagaagcccttctctttctatcttcatgggctatgatgagatgggtaaaagtcacatggtttagtcaagggcagagtctacagaactgaagactcattgttcatcatccctgccatcttttgggccaaatgtttctcaaagtgtggccagcagcaccagcatcatccaggtttaatttcagttcaacaatttcccagagatttgtctttaaaaactaattgtatggtttgtatttcaacaaagtgaggcaaatctctgcttagcaagccctgagcctgtgtggagggtgggcccagctctgtgtattgctgtagctttgcttatgacctcctgtccaaatgtctgtgctctaaggatgccatgtacagatacaatacgacagacaggtaggcagaggagagatgtgagcccaaggacacttcctatggacagttgacacaccaagagcataaggtgacatttcttctttgggggaggggattctggttctaaatgaggtgtgagtgttcgagagggtggtaaccttgtcctgttgaattacgatgagaaaacaactcagttgcctgcagagccaaaaaacaaacctcagaactgcttaattcatccgtcaaacaaactgtattttaggaaatgcaggacagagaaaaatgcacaaaagaaaagatttatttatttgtacaaaagtggaatgacaggcgtttgagcggatccaaatagaatttaagaaggaaaaaaaaatgtgattcattgccagctattaaatcttgtttatcctttttaaactaaccagaaacacattttggaaaaatccaagttaacagttgaagcattgggagctgcttcgggcactgcctgggctccctgcctacccaaggggagggcaggagtgacatgagtcagcagatttccgaactggaagggtgagcgactgtcctgatctggtcaccaccaagcctctgccaggagtccatcggtttccatatcatggcagccagaagaagacagacgtttacactgctttgaaggacacaatacatttttctaaagacacaatcaccaagacatgtgtccctccattgggtccctccttggatccctgttgctacctcccaggacgtcatctgatttgtccagtgctgtctccagacagagacataagactgaaattcttcagcacacttgacaagtggctgaaagcttggctggaatcccagttgttggtggaagaaatcccttccatgcattgctgaggtggcccttgcatactcccctgccagggcccaggagggaacagccttttctagctgcttccatgccccatcagcatcctcttgggttaatgtattaacgtgtttctgtatagtgcccttacactgagacagaaggacttagctgtacactcaaagaattaagctgttctaaataaccataaaaggtacacatatcagggggtgaggagagccatgcaaaagtaacttttctggagcagaaaccctgatctccctcttgtttttcaagcaagtaattgcagcctgaggaatatctggggctactgatctcatttgtggctgcagatgggacccctctgagtccaagacctcctcaagaactacccaagggacaaagccagagaattcttctgtctcccctcctgtatggtgatccaggtagaaggtgctagcatttaggcatttgtgctggtctgcctttggagtctgacaagacatgccctcagttgctgccactaagagcaccacctgtgcctattcactgtgttcccttttaaaagggccctacccacctgtcccccatcccctctctctgtctctctttcctctctcctgctgctcatgtccctggagattggtcccccccccctttttttgttttttgagacagagtgtccctgtggctttagaggctgtcctgtaactagctcttgtagaccaggctggtcttgaactcacagagatccgcctgcctctgcctcgggagtgctgggattaaaggcatgcatcaccactgccctgcccctttcctccttttacaattatttttccctaataaaaaagccctctgcttgaactctgtcacatggcatctttctctctcgagccacttttattacaacagaagggacaaccatgttgtgctttgccaaccttcaagcctcaatatacttggtaagcaaaaatcttacaccagtctgctcctgtttcccccaccaacctctgcactcctcattgatagttctatcgatactatatctatgtcttgatgggaagaactgggtcttattcaatatcatttcttagcaggatgcctactgcataaagaaggcctcaaatgtggtaattaggctgaggcctcctgcaaatagatacagaagcttcggacctggttacagcatgggccatctgttccaggtgcaggtcaagacatatttcttcaattgtttatctcagtatctagtgctttaaagaaaatgctttaaatacactttaactctagagccaatatcttaaccacaacagaagaaacattggacttctcatcaggtggacttgaaatctacactgagagtaagaatccatttgagatgctgtcacagtgcctatgagataggtactatgggcacaaaatgatccaagagggaatatagagaaaaaacttagaagaaagtggtgctatttggccaggctggcagttttcagagggaccagacagaaatgtcacaggacaagtgggatatgcccactaattaatgataggtgaacaaaaggcatttcttctcacaacataacactattcagccataaaacaagtaccctacatgataaaatggaatgaatgaagcatttacttatattattctattattaaataaaacccgggagtcagatatcagggtaaaaacctgattgatcagagaagcagtagagaagtggccagtgacctctctctccatcccccatccagcctctccctactacttcctgtgtctctctatatgtatcctgggtcctccaaaacctttatggataattcctgtcaaccaatcactgattctgccctctgattcaaagtaaagtttattgtcagtctcagagtgtcagtgagaacaaatatcctacaacatctcctcctatttgtctaaatgaaaagtaacagttttaactctaacatggtaaaactatatacaataagaataattatcaggtattgtccaaataaaaagggaaggttttaactttaatgaagtaaagttataagaacaattacaaagtaagaattacattcacaatatccagtccatttgtatttggcaaactcagagaaaatataatctatcctatcttggtgagtccaaagttatgtatctaattcactttttaacaaaaattgtattaccaacctagaaatatctttttagatcttaaaacattttcttagataaacagcttaagcttttatgtatctcagcttcatatacttatcatctgttttgtgaatttcttttctgaatttggtaacaaagaaaactgtagctataactatctcatcttcaaatccatcagagacccaagaaataaacctgagtaaataagaagtgcagaacaagcaacttccaaaactatagaaatgacagagacatctggctacctggacagttacctggttcctctgcaatattggggcatccatcttcagcctacaggcacagaatatctgacagacttttctgtgaagcaggaattttgaaggactgtcttaccttgtattgtcaaagcttggcagtgaccttcttttgtgtcctgcttgtccaatttggacagcattctgtcagtacttgaggcaagggcagtttcttgcccaatggctagacttgccacaatgaaagcaaactccatatggaggttctttaattcccattatcctttttttgaaataaactggtgctgccaagagcagatgtatgtcactgccatgaaaagccttgttattaaaacatcttaaattccatattccataggtctctgaagtgaagatcatctatccacctaaaatatatctctgaccttgaaaacatattgaaaatggccacagatttgattattatagatgactacctactaacctgcatttcttaattatcctaaatagtttgtagtaataactttcaagaactaaaactttatattgaattgtttaatgaactgcattggtacaatgccttaagcaagagtagaaacacatatacagtttaacaaatatatcagtatataaaattccataccaatgtaaaatatttgagactagtacttatttcttttttcttttaaataatttatttaactttatgtacattggtgtgaaggtatcagatccactggaactagagttacagacagttgtgagctgccatgtgggtgctgggaattgaacctgggtcctctggaagagcagccagtgctcttaaccactgagccatctctctagccctacttctttttttttaatctaaaagtagattcaataatctaccctttttatcttatcattcctatacctacctttttcttttcagaatgaaattcctgaatctaatctcctttgcttagcttcctctctgatcatgaccagtaacaacttgcaatcaacctccctacaggatgacaagcatccataacccattgaatgacgcaaaaccacccactctacctcttgggaatgtgggcatcatgtttttaaaattacttgctgttgtctggtagtaatgacatctttaggagaccctgagaaaactgagataatgttcaagtcctggaagagctaagtgtatcatttggtgtccagtttctatgaaatgggggaagttcaaggcttatctgaagacctagctagagtagtctgtgaggttgggccctctcagttagctgctttgaagttgctcttaatgcagatttttaaggaaactgcagcagggccattctgagaggttggatcacctgggctacttgtcttcattagtgtctagccctttattattttttgaaaatatacaaacatttaaaggtagcatacatatctgcattaacacacgtatgaaatgcgcagtgtacacaaatcagctaaagacgattctctgttctatgtttgatcaggtaaaagaaatctgtcaactttataagtctgtttggactgcataaccaaactgtaacataaatctccatccatgtcatatgaaaggatagtgtacaataagaagtcatgaagactctgtagccaacaagatttatcatgtttttcatccagtctcagagctgttcccatagtagagggatcaggttatatgccacgtgttttgtagtttttctttgtttcttctttcatgactgcaaccaagattttcaggagttctacctcagtcaaatctgatctttattcattttgaaggaatccatagttttttgtttcctgtggaagcaaaagcaaaacctctcccccagtgcaacacattttctgacttccattctaaagttaagacattattacaatatacaggctggtttaatttattagtttttttctataatccagtgtctctctgaagcatttgtcctccactcatcagcattttaaagcttcaaagtcaacaaaacaccatacaagatccagacactctgtgtatttcccatcctcacatcactattctttttatattattttactctttctttaaagactttattattttaaaattatttcggatcatttcctatgactgtctatatccatttacttttctttcttcagcatctaagcacattttaaaacattctgttcctgtttggagggttttgttttgttttgttttgttttttggtctggacctgggtttactaagcacctgcagttttctctgaccatgtgagccaatccttaaactgctaggctatcactgtctggctccacttaacacacagtgctggcagcgggctccacccccttggttcaatgaaagcctagcctcatgcctatgggtactgcccatccagggcctcatttacccaccctagctctgggaatttgctgagttcatgccgtggcagacagcagatgttcctgtctagtccttcattccagtagggcatgatttaagtgctcagctgtatagcagggcctctttaaggagtcatgtctctgtacactgcagaagatgaactttcaaaatactgtgcaagatttcacttatatgaaatttctaaatgggaaaattcagagaaacagaagtgtgggaagaaatggcagggactgctgatgacatatcccagcattgcaggttagtgatggctgactacataaaaccacatgtcaagtgctttaatgccccagccagcggggctgcaatgtgggcccaaacctcaaaggacctggaataaagggacaagagacacaagaaacagacagcaagacaggatttctgatcaagctgcaaaattttatttttctcagagacctatatagtggttgaagtaggaagcttggcagggcagggatttgtcaggtaaccaaagcccagaaagtccctgtgtgtgagtcgttgaaggcaagcagagagtgcaggtgtagataaggcaggatgctagcagggtcagggtcagggtcagggagggagtgttgctaagtaacctgactgtggaacgtttctttctttactattagctatttctgtaagtccaggtgctatttatcaggaacttggggagggaaggattgattgggactgaaggtagccattcttccaacctaatgggctattccaaaaaatgctttttacaatcttttacaagaggtcccacacaacaatgatctctcctggcacttgaaagtggtgtataaaatcaatggtaaagaaattacctagaatagttgatctccatcactgcctaaagtgaaggaaaagtggttctgtgtgattagatagaaagagacctgaaggcagctcatgggagcaaaggccatctttccttcttgagccagctaggaaccctgtagtcccaagagctgtcttggggatggatgggctattcttcagccacatttcggccaccattttctcatcttgcatggttattcagttctgattagttctcgtggcaccataatgtgaatagatgttgaggcttggttgatctcgggcacttaactgctctatctccagcaaagtcaccattatatggtgtttttgcagaagccagacatcacaaatgctggaaagcagcaggagtccggctcaggagactgactgatacacaaggcttggcaaaatgccagctctggtgagcactcattactgctgtcaaaagacaaggtcttggggtatagagatgacactatcacagggatcctgaggctgcattactgctgtcaaaagacaaggccttggggtatagagatgacactatcacagggatcctgaggatgctgaaggttgttcttccagtctacctgtccccttcctcagcaggtgccatcacaaacacaacctttatgccatttgtgtctttttagaggcaagtgtgaaggtcacccaggggccaatcctcatccaagtggaagcctaggcactggctgtgcccactcatgaaggtgccctctctgtccacctttcacacacgatgtccggttctgcactctgggtggatgagaacccttcctcctgcattagtacccaaatccagcatttccatcctcacgtacttgacctcatttccaataagtataacagaggagtttttcatgtcaacaggtgactgaaagacagcatggggggcttctcatcataccaatccagggaaggacagaaactcacagccaccagggaaggcatgctgaaatgtgacaggactaaagtgtgactttctcaatggggccaatcatcaaagctaataaaaacagaggctctgggtttatttaatttttatcatgaataaccccccagaatagtcaaatggtttgaaaacccttcaagtgattcctgcctgaacactgatcattgtttagtccctgagggtgacacattcctgatcattaatctagacacatcccagacaaccagtagcttactgagttctcttctgcagagatgtttctggagttagaaataggctttccttacttgtcttggttggtcagtttgaggggcatgaaatgaacaatacacagatatcctggatagaccaagtgaaagagtgtttgttggcagccatagtgtgctcagttattgataaggattctgggggaccaggcttgggagaggaagaaataaagaccactatggagaatggaacttgcactgtaagatgaggccatggctggagtaatctgactaaagcaaggataggattcaaagtcttgaggagtacatctggcggagacttgtgacaagtcagctgatgaccactactgccatgagaaggaaaaggatcttgtctcttggcttctgtggtagaaggtagatgtcattccacaagaggaaaaatgtcccccacctaaagcagtcaggtgccgatgaggaagttagtacagcggtagaaactagccatcatttcttatagttgtaatatagaaaatcatcccaaacaccaaaactgaataacagcttctctctgaatgagggtagtaaagcagtgttgtatttacagtcaggtctaaatttgggaaattcttgcaaaggtggaatctgggcatgagctaaaggaatatccaacactggcactagctaacctgcttgcttggctgggcacatttgactactttggggcagataaagtgatctagaacatggagcaggtatacagcaaatacagatcatatcaaatagtagatttaggcaaccctatgtgatggatgtgtttagtcatctttttctttgaaaatatgtaataggtgattagtagttagagaaagggatgaaaaggagactatcagcattgagaaatgctatatgtaattaatgtgcatttatagtttatgtatttccctatgtaggccgttagcctgtgagagcagcgtagtatgcaatgaagagtatacaccatccttcaggggttggcagatgaggatccagccatgtgacccttggcagagtatggtaggccatgcttttaaatgggttgtttactttgctgtgacctctctgacaattaagtttcattcaggcaatgtgttggatgtacagcagggctgaaaagatccactgtgatgtatgtggacccgtttcaaagagacagaatctgagaatcatccaagaccacaggtttcacaacaacctattccccactgaacatggttgagccaatactgggtagtttggcaggcaggaggattggaaggaattctttaatgtgatggcagagctcacaagtatcccagcagctttggaagactgagtatcgcttttgtgaaagacagaggaggagctgtctgcagaggtacactatgggaattggaaagaactgaagggtaattgccaagacagtctgctcatcattgcctgagggagggaccgagtgatgctccatctctttggaaggcccctttcctcacaaactggaagatgtcagcatacaagtcccagactgcctccaacagctgccctttccctgctagttctccagagacttgattctcatcttctgctctgcagagcaatcccttgaggctccaggataagggaaacctgtatgtttccatggtgcttgtcacggttctgtggtttcagtaggcacgccattaggagtctgggtgaatgaaccagataacactctatgtgcctctttgcatgtcatcttagtgatgaagtaatgggccaatattttattgatgataaagaattatgaataataatggttgtgttctttggaaagtatctagggaaagatatgtacaaacagattttattttttgccatagccatgaaataactgctgtattggtgtataaggaatatttctggaagaataggtattgtttctctttctaaagaaagatttctaaataaagagcataatgcaatgccaaagattaagaatattgggctggaaagatgactcagcagttaagagaactggaatgctcttccagaagacctgggttcaattcccagcacccacatggcaactcaactgtcccaaactccagttccagggaatccaacacctctacagacatacatgcaggcaaaacaccaatgcacataaaataaaactaaataaatacatttaaaaaaagaatatgcttggaaaatctaggagtcagtgtgagaaaaatactatcaacaataaaggactcaaataaaggtctatgatgcttatgaaatttcacttgcaaaaatttgactttaagaaatggtacattgaattgagtttgaccagccagtgttttctttatattactgagatttgccataaagtatccatgcatttataaagaagtttattagatactctaaaatacttaaagtctatgtatatatactgaagtatgtatatatataaatatatatactaaagtctttctctctatatctatctatccatctatatatatatatatatacatagactttaagtattttatttattctatgtataatacagcttcttttaaaaaatggaaaaatgttaaagttgcatttcacagacttagacaactttctcatttaactatgggtctctagacatagcctagaatgtattttttttgtaaaaatccaacattaaaaacagtcactgcacctgagaccattctctgggagattcacaagaaaacattttaatttctgttaacatatgattctttccatgcattcacctcatgatgtaaaaaagaaaaaaaacatagtcacaacaggttctcactgattgggtgggaaaaggagagcaatcaagagtctatgggaatggtccaataagatatagagaaagttggttttaggagagaacaagaattactgttctataataatatggtaataccattatactataatacagtcttgtaatattaaaattatctaacaaaaacccttaatttttatagtggtagcctgaactatctgtgagtggaatgtcctattgcctggagcctgctttaaaatatttcagcaagaggaaaagaagtgaagcaacttgcacccactcataattctttgtttggctggctgttttttttctttttccttttttctttttttgctttgttttgtcttgtgtttttagacagggtcttactatattgctctaactggcctggaattcactatgtagactaggatggtcttgaactaactgagatctgcctgcctctgcctcctgagtgctgggattagaggtgtgcaccaccacgcctgacctggaatacacaaatcttatgagaggtcttgctatacatggggaacaaatgaagtctggaatgaatgtgtattgtggacatgagcaccaccatataagctctaaagttacacagagaaaccctgtctcagaaaaccaaaaccaaccaaacaaacaacaacaaacaaaacaaaacaaaacaaaacaaaacaaaaaaacctcaggtgcctcagactcctgggaatagcaaggccttgccttgatctgggtatggatgttgacagtatatacagagagcaacaaccagagcttcctcttccctgatgacagcagctgagactgctcccctatagagacccctgctgagattagataaccagcctcttcctcattcatgctgagttcccaggctgctgctggtgcatcctcatcagagcacacagtcaccctacatcatcttttctttcctgtctgttgtttctacgctccactcaccccagtcaggtcagtccctggccttgcagatcatagcaactatagaggaaggaaaaggcaaaagtaatgcttggcttggcctcgagatgttcttggtagtccatttgctttttgagacaggagaagctataggatgcttgaggggtgatacatgagcgtgggtgaggcacgcagggtaggcatatccagcgtgttgtccttgagtaggaagaatggatgagacctattgggtgtgccacatttatccagagtcaaccagagatggcagagaggatggggaaagggcaggcttctattggttctagtaagtcacaactgaggtcatggaccaagggtaaagaataaagagaacccactagaggcttaagcagagaggaaaaggtgagggagagaggcagagttgcctatagaaatgaaacagaatttacagagattatcagagacctacttgaggctgagaccaaccagtaagtggagaagctatggtggttgtgttcatgatacactgctctctttctctcaccactctctttggtgcagtgaccatgaccaattaactctctatgcctacctgctgtagagaacacactctgcttgaatatatagagtaatctggaggttaggaagtatttctgccttcacaaagcagcaatcagccaacagggctttggttgctattaaggactgagtatttatgtttccctgagattcatgggtgaaaccctactgacagatagttgcaaggctatgtgatagacaagagacactgaggttggatatagatggaagatatcagtgaatgacagagctgttgcagtgtgggaggaggtgtggaacacagaaggatgaatttgagaacgtgagttggagagaattgaaaatgaggttagctattaagcattatccttggaagaggggaaatgaaggaactagaaacccagagcgttgcgttatgacaggagcagagtcagggagattgaacctggtgggaatcttcaaggtctcatctgaggctcctgggtggtcaggcattccctgatgtttgagaagcaaggtgagagaatggtttggaaggtagatggagagcaaggaggtacctgtcccagttgaggaccacgtgagaggactgtaaggagacggctcctgcagcttcatattcccatctgagtcagaaagtaaagtgctatacagacaagtgatatagacaagtggtggagaacattggtggttttgttgatattggtgtgaatcctacacagaacatccaggaaaagtctgggatgcaaacagtggagggctggtcacattggggacatattggattctgtggcgatgcagctgaatgagaagggggatctgggatcttgggcttcttgttatgattaaaaaaaccaaaacaacacaacaacaacaacaactaggtagcaaatggggaagtagataatatcccaggatatataaaaatttcctttctgattatccatttctttggcatataaaagaaagggtttaattatgacattttcacatatgtatgttacagtatattttacttacactaacccttccttgtctctcctccttcttcccagcagcccccccccccacacacctggcctcctctgctcctctgttatatataatatgtatatcccactcttagtctccctgtcacctttgtgactgtcagggtccttcagtctttctctctcaggaacaaactctgttttttggttgacaagattcctctcatctaccctatctcatgaaggcagcttctaatgtgctgccattctttggaaacctcatatgaaatgtgtccctaacacatttactcttccccaggactcagtctctgacagtccatgtcttcttttcactcttcatttttcctttgtcagaggtaagaacggagattacccagtctgcaaacttttcagattgtcttatttaactcagttgtgtacatttaagcttcgcacttgtcgttatatagcgcagtggctcatttatttggaagactgaatgatggttcattgtctgacattccattgtccactcaggtttgaaggtgattttggtcacttgttctggatgttttgagcagaactgtgattgacataaacaaaagggtttttgtgagtatctaagttatgaaggagcacaactgctgattcatttggttataaaaaatatattcagaagaaataggcagcctatctccaaaagtagctgtaacattactaacagggatggtgaggtgactcagtggataaaggtgcctgctgccaagcccgagttcagtctctgagacccacccagtaggaggagagaacaaattctcacaaactgttctccgatcttcacacatgtacatgaacccccccacataccacatacaagcacatgaacacatacaagtaataaataactgtcataaaaggttttttaaataaaataaaaagcccaagacattacccatgaatgagagtccctgttgtctcatgtccttagccacaactagtgttcttctgtgtttttattacaactaggaaaaaaaaatcagtggcagacattttgtaatcctggctccaaatgatacactaagtcctagcaagttccctatttccacgctctgaaaaacacatttctgtattaacataactgcaggagaatttgagatattctgtgggcagagacttgagaaggagacatctttgtagaggacatcctgctttgaatccaaagaatcagtcatggacattgtccagccaaggaacacaaactgtgagtcatcagttgtcccgacccaagcttgcatgtgttatgggacttacttccccacagagactgggttctgtactgtttcagaacctaaacttacatctccaggataggtatggcagtcttcagacatccagaaattgaatttaccatttcccaggaaccattaccaggagcagaacatggtaaaacagccgacccctctcctagtcaatcataaagcccagctttctttcaccttgaatcatctatttgccactgtgtgggaaggtggctttgggtataccaacacactgaacagccccttagggattcagtttgattcatgttggtggcaggggcatgccccatataccctttcttgtctcctggccctgaggaaatgctctctgtcctcctcacatgcagaggattttaggaagaggggacatttcaaagtattgggtttctcgctggaagttaaaacaagacaacacagcagcagggtttgctttgctagcttgactggccccttgggtagagagctgcccagccctggcaggctctgcttccatccaaaccaaactttccccagtgacctcagggaaagatggtttacatcatgaagagaaagcccatttatttatttgcaataacttcaaattttatggagccacaagaggatataatttaagaaaacattagcaaacaattccaaataccttcaaggttttacagtttgccaggtcaaagattcatcaatggaactatttcaacattaagaatgaaaagttacatgagcattccttttgaacggggctggggaggtggaggtatttcacgatgtatatttttgttcatgacatcctggggtctaaggaaaagacaactgagtttccaggaaccattctgagcaacatatgacctaagagaagtgggtcctctaatgctgcccttgtggggcattagccccataaataatggaggcagaacatgggctggtctaaataaacctcttgagccttgctttgaacacagtgttggagcaaattacgtggtgtttttattagggtttttaagacaaaataaagaggttaccaggaaagggagtgagctaagaatggccccttgctgttgaaatatgttggttttaaagttccctttctgttagcagtcatctgttggtggtatatttaatctgctaaaacaaccaatatcatgaatctttaagaaagtatttttgaaccgtgttcaacttttttttctgaattagcgattgaatgtagggcctaacatatgctaagaaagcactctaccactgcgctatacccctgtctttgcaattttctgttagaagcatgcaggagccagtgctggaggacacaagttcctcacccaacagaccctcaccttgttcttccagggagcacaggttgggaagggcggatgtgtgcttgtgatctctcaattgtctcagtgcagatacttacactaactcttacttacactaaactacttaaaaatgtaggtgtttatcttcatactgcacctttctcagctggcttcttgaagggtgcaatcaaatctcgtaggtttgtagccccagacccaccctggtgctctttttgctggctacatttagggctatatactcacagggtactgagttaagcactgtgacagtttctctggaatatgccatgaaggcccatgggtgccttaggagatggtgggatctgtaggaagtggagcctatgggaggttaagtcattctgggtgtgattgaagaaagtagcagcaatctactgtctccaccactgaactattgcctctgttcatgttaagcactttttattatttccgttacttgacaatttcatgcatgtacactatattctctaaatataatagatattatatgttacacattataatctgattgccctctcccttcttgtctccttttatttatctcagcaccgctgatccatagcagtccctttcccaggttcatgcttttgttttgtgaaccacttaatctaaccagagccatctgcgacaccattggattggaactatccattggatgctggtgtagtcaccagtgaacacacaactaaaggtcatggttccccctctccctgaatctatcagtagcaaatagtccagcagtgagtggtagggtcccctgaacccctcctctatttatatctgactattaatgggcccattattctatcgcatacaccccggcacctgtgagtttgttcacattccttgcatcttgcctgggagatgatactccacagcccttctccgttcttgctcttaatgtttcttcttccaccactcttcctggagacaaggtctcactaaattactcaaatttgcctcttgccctgtgatctcatgtagcagggatcacaggtccgtgccaccaggctggacttctctctttttggtgtcttagccacaaggtgagtagttttctcacgtgtaactgggtgtgctgcctcctcatggaccgcaaagcgacgatgccaatcaaccatgggctgaaacccccaaagctgtgatccaaagtaattttctctttatgagctgcttagctcagttgtttgttatggtgaaggaaactgacaatcccaagcagtcaggagtgaggaacagtctagaaaagtgatgaggtcatcttaaacagcctgagtctgaggagaggagctcccccttcagaacacagctcaggatctcagcccaagagctaaccaactcttgaatagcaagtcacaaacaccttgttcttggatccacacaaaatcatttacagaggatagattctccccctccctgtttctcaaatgcagaaatggagaattaaaaaggcttaagttgcttttttccccaaggtcagagagcagattcagagtgaagctgggtctttgacctacaggtttagtttggtttttgtcactgtgacttctccccatacttttctctaagtcaagatattggctgtgtgtacttaatattttttctttcacggtaactttattcaaatataatttatctaccataaagcccaccctttgaaagacacacctcagtggtttttagtatactcacaaagccaggcagctgtcctctctgtgtaattccaaaaccatgtcaggacatcccagaggaatcccatgtgattgtgttttcccccctccccctaagagctctctccttttggtctctctctgttcagatattttatgtaggtgggatcatacaccctgtggcctttttgttggtttatttcacagggcatgatgtttcctaggttcatctgtgccatgtgtcagagactttatcctgtatagacatatcctgttttgttcagccattcactggctgatgggtgtgttgtgtccattcattggctgtcatgcataatgctgctataagcatttcaatacaagtggtttttaggaaaatgtgtccttaagtcccaggcgtagatctaggaataggaattgtaaagttctatagtaattctgtatttaagcattttgagagacaaaaaagtgttttccagtgtgacattcctattttatgttctctccatcaatgcacaagaattgcaagttctctacatcttcatcaacatttattattttctatttctgatcatagctgtcttaggggcagtgaactgaggtctcactgcgatttcattggcatttccctgagggctaacaatttccatatgcttaatgatcactttcaaatctttataataaatattttcctattgaggcattaacatgttttagtcctatgctctttttaaaagctttatttatttcatatgtatgggtgtttatcttgcatgtatatccgcacatcacatacatgcagtgtcctcagaggccagaagagaggttcagatcctttggaactggagtaaaaggcaggtgttagccaccttgtgggagcctgggtcctctggaagagcagcaagtgttcctaaccactgagccatctctccagcacctgctgtgtccatttttaatcagattagtttaccttattgaaacgaattgtctaatatattctctatatgttctagattcatttccttagaaaaaaacctccagatagttcaccccattctttgtgttcttcttgtttttctcagtggtactttttgaaataggaacacttagattttgataatattcaacacatactcaaaaaatgccttgtgccatttaaagttaagaaatcattacttaattcactacttaattcaagatcataacagttgctcccattttttaaagctttattgttttcattcttattcataagactatttgaattatttagtatatggaatgaagcagaaatacataaatattcacttttgctgacacacttgcctgtcattggaccaaaaataacacaatataggttacagacataagcgtaaaatctgagactacataactactgaagaaaaaccaagggagaaaatcttgttaacattggtctaaacatggatttatgaaaaagaaacctcaaaaacatgaaaaataaaagcaaccaaggcaaatgggattccgttaagttgaaacatttctatactgcagaaaaaataatcaatggagaaaacaggcaccttcagaatgagagaatatatcagaaactattacctcataaaaagttaacattcaatatacaaggaactcaatttaataacaaaacccaattttaaattaggccaaagacctgaaatggcattcttcaaaaaagagattaacataactaagcattagggaaatgtaaatcaaaaccacaaggagattcaatctcaatccagtcaggataacttctatccagaaaaaaaaaataagaccaaaaccaaaccaaaacaacaatgacaacaaaaacaaacaaacaaaccaaaataaaaaaacccaaccaaccaaaaacaaaaacaacaaaaaacaaccccaaaagataacaagtgccagtgagatacgcagaaaagaaacctctatgcactgttgatgggagcgtaaattagaacactcataggaataggaaacagtatggagtggctggagagatggctcagcagttaagagcactggctgcacttgcagaggacctgagtttggttcacagcacccatactgtgcagctcataactgctggtaactccatctccagagaatctgatgtcctcttctggcctccacaggtacctgaactcatgtgcacaacacacacacaagacacacacacacacacacacacacacacacacacattcagtcagaggttactatcaggcatcttcctctatcattctccaattttattctttgaggcagggtctctcactgaacctaagcttatcatttcatcgaggctgattggctagtgaattccaaggatttcttcctgtctccacttacctagtgctgggattccagatgcacgctgctgctgcatccagatttttatgtgagtgctttggacacaaactcaattcagcaaatatgtaactgacagagccatctccccaactcccttcttagaactgttctatgtaccaaatcaggttgtctatcaatataaatatcttttttatttttatttccaatctatgtgcagtttatttctctttcttgcctaattgctatggctattgcctccagtactctgttgaatagaagccttagaaatagatatccttgtctttgtctttatctttaaggaggcatttatttttttaagcttttaaaagaagcttttatttattttatagtatgtgcattacaggaaacaaaacacaagaagccaagaagagtctcccagtcacacacagctcagcttgctgtgtcctgctagatgctgcaatgtacatacatttagggaattgagattatacagtatgtatcaagctttcccccacattgtgaatattcaccaactaaaaaccccaatgctacatgagtattttgttaaccaagaatacacctcgccatctcaatctgtcagacaagactgtaatcctgtcttccttggcaacaaaatctcatagaagacaaaaatggcagcaggcttctagataagaagtactggcgaagttacaattagaattctgcatttggaggcatttattttgaccattagagggcatcatgtagatctttgacagatactttatcccgttgaaggaattcttttttgttcctaattggccttgcatctttcgccatgaaagagcactgaattttgttacatattgctgcagatactgagatggatgtgtagtatttgtcttttattgtcttttacattacactgatctattctttatgttgatgcaacctagaattagtcctacttatgttaatagtccttttttatatgttgctaaattgagttcagtgattttctaaaaatattttttcatcagtatgcagagagatattagtctttaatttttttgtgttttaattttgtatcagtatagtactgttcttatgtgagttggtgagagttattgtttctgttttatagacgaggcttttaaaaataatattcttatttattcttggaaaatttagtgtgtgtatgtaatgtattttgatcatacccatcctcacttcctccattcagtttctctggggatcccacagcccatctccttctccacttcacgccctcttatagcatttataaatatccttctttgtttttagtaataacatttatcctagatatgtttactttattattatagctagtctactcatcttttgatgatatttgcacaacatctttcccctcaaacttgcttttactctgtctcttaaagtctaatatgctcttctgtcaataatagggagattagagttagcatctgggttttgtctgtttacttgttgtaccaatctctgtcatctggttgatgtttttaaattttgcttctaatgtcactgttgataattgggatatatgcttgtcattagctagttttagtttgtgttttcctattttactccattatttctcaattactgccttcttttgcatcaggcagatattttctattttattattttgattccttggttgtatttttggcaggtgtgtgtgtgtgtgtgtgtgtgtgtgtgtgtgtgtgtgtgcttgcctttggataccaaaggtgcaccttgaatgtggttcctcaagagttgcccaccttggctttgtttgtttgtttgtttttgagacacattctctccctgggacccaagtcttgcagattaagctagattggctggctagtgagtctcctgtcttatgggtcctgtcttcaccttcccagggctgggagtacaaacacatgccaccatgcccagcttttgacatggctgctgctggagatagaacctaggtccttgtgattatgcagcaagcattttaccaactgagctatctcttcaacaccttaaattgtagctttcaattttgtttttttttttgttttgtttttttgttttttttttagtttttccctgggattacaaataacaccttaatttagaacagcctggtttgagataatgccaacttcatttcaacaatatagaatgctttttctccagtacagatgttttatccttctctcttgatctactattgtcatcatattgcatctttatgcattttaagcccacaaatgattctatagttgttgcattgtgaacttgtcttttaaatcacgtaggagaaaaggttataaatggagctattatacactgtcttccgcatgtgccctgtgtagttatttttattggtgggttttatttctttgtatgatttgagttattacctagtgtctataatttccccccaaagggcaagtctgatagctgtgagttattttcactcctgttgatttaagacgatcttaatttctctagtttttcaatgtttctttcacagaaatagtatttttggctgatagtcttttaacacttggagtatatcatcctactgctgtctgtcatttatggtttctgacaggaagccggctgttaggaaattatcccaagaattgacgagggaatgaaaaagttctgcacagagaaggaaagaaccagtagagtaagggaaccagctacagaatggaagaaaaacctttgccagccacacatctgataagggatcagtgccttgaatatatgaagaactaaaaaagttaagcacctctccacaaataattcaaacgataagtgggctagtgaattgaacggacaattctcaaaagatgaaatacaaatgaaccataaatactgtttaaaagttcaacagccttagccactagggaaatgcaaaattgtaaatgtgtttagatttcatctcacacaaatgagaagctggaaagatggcttaaaggttaagagcgttggttgctcttcctgaggacccaggtaaaatccctagcacctaaatggcaccaaggcctgtagttttgggggaatctaatgcctcttctggcttccacaggcaacgcacaaatgtgggatttaaggggaaggggcctaaaatgagggaacagaagagatttagagaaggcaataaggagaaaaacataaaatatcacacattttcctctcatttactgattttttttgttatggtaaagcatcaagaacaatatgtagaacataaagggttaatttagtttaccattccggggggagagtccctaatggcaggaaggcatgacagcaggtgaccagaacaagaaagaagcttatatataagatttttcaactgcaatcaggaagcagaggatgctaactggaagaggagcacagccatggctcccaaagacttacccctgtgacatgcttctctcaacaaggctgcatctcccacaggttccacaacctcctcaagcagcaccactaactggggaccaagtgttcacctacctgagcctatggcagacattgctcatttaaactgccatatatgcacagcacaggcttaaatacatacacagagagagatggtagaaaaaactaaaggcagactacttgggggaagaggaccagcaagagtggaggaaggaaggggcgggggtaagggaggagcaaatatgagcatggtacaatgtaagctatgaaagtcaccattttgcatgctaacttaattaatcaaaatgtcaaccatgtattcatgaacttctttcttttgttgttgtcaagagtctgtgctttgtgctttgtgctttggcaatttgaaaatatcctttccaggggtagaactctgaatttatcctactaggagtttgctgaacttattggatgtgtagtttaatgtttcaatccaagaggaagcatttcaaccatccttggttcaatttttctttctttactctctctcctatctctctaaggatccaactgtgcatgcatgggtttgctttgtggtagcatacagatttctaatgcttgtgtgtttgtattggtccttggactgggcagcctcatttggtgagtcttttggatttcctgatcttttctcctgttacctaaagtctaatgttgggtcctgtgacagttaattttaagtgtcagcttgaccaggttaaggaattcctcagctagccgagaaagcattatgtttatgtctgtgagggtgaacctagaaacaactggaatttgaatcagtggactggataaggagaacctgactttacccattgtgggtagaggcacagcaaagttagttgaggacctgaatagagcaagaaagtgaaagaaaggcatgaatttctatatctggatgagatctagagatctagatctgaggtagatggtatacagacagagtcctagttagcactaattgtcaactttatacagcctagagtcatttgagaaggaagtcttgcttgaggaattgcctgaatcggattggcctatgggtttgtttgtaggggattgtcttgattgttaattgatgcaggaggggccagcccacggtggatggtaccatcctaagtaggtagaactcactgtatgagaatctagctgtcttagttagagtttctattcctgtgataaaaataccatgaccaaaagcaacttggagagaaaggggtttatttcattttacagcttatagtccatcacctaagagaatcagggcaggaactcaagacaggagcctggagccaggaaccaatgtagaggccacaaagaaatgttgctcactggcttgctcttcctggcttactcattcttctttcttatagaaccaaggaccaccagctcaagaatggcactgcccacagtgagctaggccctcccccatcaaccatacattttctaaaaagtgtcccacaggtgtgccccctggccagcctgataggagactgttcttacttgaggctttcttttcccaaatgactctagcttgtgtcaagtcgacataaaactagccagagcattgactatgcaggagtcttggtgggcctatttcaagttcttgccctgaatttcctcagtgatggactgcaacctgtacaaaaagcagaaagaaaccttttcctttcctaagctgtttatggtcatagtatttgtcacaaccactgaaagcctaaatagacagaataaaagacagacagacagacagacagacagacagattgattgattctgggctttggagaacgttgactaaaataggtcctcagttattttttttccaactttttaaatttgaattagaaacaggattgttttacatgacaatcccagttcccttctcccatccgtcctcacctaccacccccccccccaaatcttatctgtcacatatcttttctgctctccctggatggtgaggccttctatagggtgtcatcctcagtttttttttttatttcaattattgttcctttctgatctcaagtctctatttggcactgtgggtactttctgttttcttattgatgtcatctatttagtgaagtgtcattctcaaactttaattcattagcttttagtgattaatatttgaacatactatagctgacaatgtctccatcatccaagtccaacatctgggcttccttacagaaagttgttactgactgtctcaccacctgtctaggccacagtttccaagtttctttgtgtggctcctaagttttcctggccacgatgaacataaactgttatatcctagaatctgatccttccttctcctagtgactatgatgctacaaatgccgttgcttctgttacccccctttttccccccaagatagggcttctctgtagctttggaggctgtcctggaactcactctgtagaccaggctggtcttgaactcatagagatcctcctgcctctgcctcccaagtgctgggattaaaggtgtgtgccaccactgcctggattttgttagttctttagtaacttcttgatttggataaaatacatattttttgtcatatgggactatcgaagtatccacttgtgagcttagaaatttaatgatggcaaaaagacttcattggatgggtcaacaactaaatttcccatcttttctgatgggacccatggcatgttgcagcacgttttttgtgtacatgataactctaccttagcatctatgtcctgctatcccagagcctgaaggtcaaggagaagcaagaacttctggctttcttgtgctctcctcccctctcccctggcttgaacaaaactctagatatttgtaaggtcccttgattgcatgtgacccactagacactcttggcatttctgtttttaagtttgtttggtttggtgggaagagacaagctctcacgtagcccaagctgatgttaaacacctgattatcttatctctacctcccaagtggcttttaaagattcttagtaaacctcttagctgagactggacatgatgccttgggcatctgtgacattaaataattgtagctgagtgttttctgtggctgcctaggggggagatgtttgcacacagctctgatctggaccaaataaagacagatcttggaatggaactttgcagcaggctgccaaatcattgagtagtgacactctattggggatacaatttttaagggagctccaagcctctctgctttcttcagtgactgttggatttctagtttcagtttccatatttcctagacttttgacctttccatggacatgggtggagggagtggagttgggttcagtgaaaacttgaggctgaacctgatctggactgtccagggttctgaggtcaaattctgatccaagtcaaaagacgaagtaaataagttgcacatccttactggcgtggcttcctttctaaataacaaggctgtcagtatttcaaaagaaactgtaactgacaatgccaagtgctggcaaggataggagtgactcaagctctcatccactgatggtgggaatgcaaaatagcaagccgctctggaaaacagttccccattttggataaagccaagcacacgctttctgttggataccacagtctcattctgtgatatttactcgagggaaaagaaagcatgtccttgctaacatctacatgtgaatgtttatagctgctttgtgcatatcacaacaccaagggagaatatgttcttcaactggcaaaaaaataaacaaatgaggtacaagcacacagcagaattacatttggaaaaaaaaacaaatttcttatattccaatgacatggatgaatctcagtggtttaccccaaaggaaaccagactcaaacaactgaagatggggtgattttatttatagcatggtctacaaaaggcagaggtcgtcagagagcctggagatcagaaaagaaaagaaaaggtatgaaatattttgaggtttgttttgttttgttttgttttgttttttgagacagggtttctctgtattgctttggaggcttcctggaactagctcttgtagaccaggctggtctggaactcacagagatctgcctgcctctgcctctgcctccgccttccaagtgctgggactaaaggcatgtgccaccactgcccggctggtatgaaatattttgatagaagggctgatgtagcagttgaatgtcttgattcaacaggggtggttcagggattgtgccttttctacattggaaatatgtatagatgtacaataaagggcaaacttattatatatgttatacattaatttaaaaagttagaaataggaaaagaaagaggcaggggaggaggagaggttgactctgttttattagtctcagtaaagaaaacctattactattattattattattattattattattattattagttaaatgtattcaattattttacctcctgactgcaatttccctcccctcgttactcctatccctgaccaagccacttctcctctgtttctgttcagaaaggggcaggcttcctgtggtgtcaacaaatcatggcccatcaagttgtggtagaactaagctccttcccttgaattaaggttgggcaaggcaacccagtatgaggaataggttcctggaagccagccaaagccttagggacaggcccttcttccatcactaggagtcccacaagtagatcaagctattacacatatgtagagggtctaggttggtcccatgtcagctccctagctgttggtccagagttggagctcctatgagcctgttagttttttctgagggttcccttgtgatgaccttgaagcctcctgggtagtacaatccctcctccatctcttcaacaggattccatgagctcggccagtgcttggctgtggatctctgcatctgtttccatcttcactggatgaagtctctctgatgacaattgtgaaggttaccaattgattacaagagaagtccagttcaggctacctatccactattgctgggagtcttaactgaggtcatccttgtagattcgtgggatttccccttggaccaggtttctacctgaccccaaaatgcctcccaacaagatgtctctttcattgtctcccctccacccccctaacccaatcccttatgttcccattcctgctggcccctgtctatcgaggagatctatttccccttcccaggggaatccatgtgtgtccatcctcccttgggctctccttgttacccagcctctctgtctatggattatagcatgattatcctttattttacagctaatatctgcttacgagagagtacagaccatgtttgtctttctaggtctgtgttacctcactcaggatgatttttttttccatcctagttccatccatttgccttcaaatttcctaatgtcattttttttaacagctgagtaatacgccattgtgtaaatgtaccacagtttctttatccattctttggttgaggggcatctaggctgtttccaggttcttgctattatgaataatgccttttgaacaccgaggtctgggttgtatcttgggcagcttcctgcaggaagcttcttaggtctgaacttctctccaactaactgaaaatttagatacccagatagctcagttgagagggatattagtgccattccagtttaatcaacagctttgtgctggggtcactctctcccaagagcactttctgaccattgccaacctctggggcatgttggggttcctacagccattgtaagatgcaggtaccttgattctgagatgatcagatcctagccattgctggagctacagctgagggtgctaccagtagctgaccactcccttgcaagctgagctttgtttatcctatagttggagatcatggtataaagaaaatcaggcaccagcaccataggtggaacttgtaacacatagcttagaaaccattgttctccgttctggtgcagagtaaatacttgcttggttacacttttgaaatctatatgaaaagactatcagctaaatagaggtgttgcacaaggaaagacgttcagatatcaaacattcaagagggagaaggccctgtgatgtgagtagatcctgctctgattacatactgtctacagagggaaggcttcactgggtgtgggtttggattcacactgctttctactgtgaaggtctggaaaggtgctggggccagggtggctgccatcccagtggagacacacagtgaccttaactgtcaagcatcttcggcttgtagtcttgaactttcttcttaggcaggatgtggcttcctcactccatgctaatggatcaagatgatgcaaagcaatccttgagagaagctgaagggagagggaagttgtgggtacatccctgagccatctaaggctgtttccttcccttcctttcttggcttgttctgttaggaaggagggccactaaagaaggacgtggtatcctctggctcagagaagctgcagtttggacttagcgagcacagtggagttctcaaagctccctctgggtgggtgagactgcagtctgtagtgagagcatccgaaggaggaacagctgccggtgtttgcaggtgcacactcggcactgtggtgggagactcctagacagcatgtgtgaatttggagttaggactacacagttgaaacctccaatgggagattaaagtcactgcttaaagtagatgtttcagggctgtgtagacggctcagctgttatgagcatgtactgttcttccagagaactcatatttggttcccagaatccagtctggaatctcacaccacctgtaactccagttcaagatgcacctagtctccatgagcacttgtacattctctctctctctctctctctctctctctctctctctctctctctctctctcacatattctcatgcacacaaaatttaaaattgctaagaaatagatcttctaagatggttgttgcctgccaacagtggcaatgggatgggggaaagtcagcaatccagtgtgctgggggtgtgctctagagtggagaattttcctcttggtattggatggagtgaatcagagtgtatcagagtgtttacaaaaacactgtagaatcttcaaacatccttaaataatgacacagactctcatttctggcagttctcagggtctttataacttttcctgttttttttttttttttttttttttttttttgtggctcatcccactcaaccaagtaagttatattaaaatagaccaacactgaggaacagcaagcagcaagctgaggctgctgctaagggttgtagatggcatcttgggctcctaggaaacctcttggctgtgactccaaagctccatgcatctttctgaacttattctgtcaccctctacagtcttggtccatgtcccagtgtgacccacttgtcccctatgtcccatatccagtccatttatcctgctgttggattgcagtatagcctttaggctggaagggatgtattaacaatgaatctgttgcactttgattccttattgtcctgtagctatctcctctgaactgaagcattctccttggagggagaaggagggttcctaagactttgggagctaactaaggttacaaggcccaggaagctcatgaaagttacaaggtcctttccaaattgcataaactgtaagcaatcagtggagacgcctgtagcttgagcagggggctccacgcatgcagctctcattgtttcttgccagtgcagggataggccctctggtgatgcagctgcctttgagtcagccatgccccaggaagtagtccctcgcccatgcttctgtaagtaaccgctgtaaccttgcctaactaaggatttgcgtgcaagcctttctttggtctgtcggtggtgccctgtctggggtgcgtagatgtgtgttcatatctcctcaggaagaaatagagcaacccttatttttaactaataaggggcatgggtgtgtggagttttataggtgtgtgtgtgtgtgtgtgtgtgtgtgtgtgtgtgtgtgtgcgcgcgtgcgcgcctggcttatgtgtgggtgctggtcctcctgtttgcacagcaagccctttactaactgagccactttccagccgtgttaatagtttgtaatgatgaaacactgataactgacacttaactttgctataggatgaattacctttcctagaactttacatattgaagtcctaacccccacggagtctgtatttggaggaaggaccattaagaagaaattaaggccaaatgaagctgaaaaggtgcaatcctcacctaatcacattgccattcacataaagggagaaacagagaccaagatatgcacacagagatgggccaagtgaggtcctagcagcaagctggccatctgcaagccaggggaaactgcaggagaagctacatcaccagtttccagactctagaatgatgagaatgaatttctattagttaagccatcctgcctgtcgcattttgctgtggtatttatagtagtctattactttactgtgaactgaaaccagttaagtgctttatatccattattttaagtaaggtcttttaagtcttttaagcaaggtcatgtgataatccccagcgcatagatagggaaacactagtgaaataaatcagtactgagacttgaactccagtctgctaactgaaaagctgtgcacatatgttgaacacaaggctacctcaaaagaaagcatatggtctagactgctctcagagatgggcctgtttgtgttggactttaatgcttgtgtgtgtgtgtgtgtgtgtgtgtgtgagagagagagagagagggagagagagagagagagagagagagagagagaagagagtgtgtgcatgtgtgcggaggccagaagtcaatggcctatcagcattgtccatgggaaaccctgactctgacagtgacagagggcctgtcatagctcccctaaagctaagtccatgtcttaattgaaggaatctgtgactataccatatatggtacaatagtgaacaccaccttacatggcaaaaggcatgatgatttaaggaagaggggcttgtcctggtttatacagggggaaatctaaatgctttcacaggtgccaaaagaaagagacaaagattgatggcacagatggaggaggaggaggaggaggaggaggaggaggagggggagggggggaaaccagagaggggagaaagcaaggtgaagactgaacacagagagaagcagctacaagtcatgggattccaacagcttgggtttggacattgggctcctagacctatgaggaagtcaattgttgttgaagctacccagtttgtggtggctccttcagagactcagacaggagccttagacacctccgtgactcctctgaaatgagcatgtgaagttaaggtgatggctgtagcccactggtgacgatgctacaccaccctcacctccctatgtagtcaccaacatgtatgaaagtgttgagatggctggacagatggctctggctgtggtggactaactgctgggcaagcatgaaggctggagtttggatacttggcagccaccaaaaagtactttagggcaaaggggtctataactcccacccctgggggaaggggaatagagacaggggaatccttaatgttcattggccagacagtctagccaatccatgagctctgtgttcagtgggagatcctgtcttaacaataaggtgcatgacacctggtgctgaaggttttgaagtatgaacatcctcccaaagcaactggcaggcactacctggagggtgagtgaaggagccctccaggtgagtctgttggtaccagcccccagttctgtgttcagatctgacagtttgcatagtctgtgatacccattgcccctcatccccccaccacaagcctcaaagaaccacgtgaagttttgagcagtgagaaaactatgaatttccagagtagaaatggagggtcctggaggccacccaagacaggtagggaacaggagaggagcacagtggtggctgcagtggaggccagccacctgggaggtctaggagcctcaaaaacagcacggtggaggggccaacgccaggcacctgtgaaaatagcaaatacttgagccagagaggcaacacatcctgccctgctcccagaggctccccaccgaggcaaggatcaccaggccggggtgatgtgtctcccacggtgtctgcgtcccctgggccccacaggaatttgacatgggcaaccacttcaggctgcagaaaagatactggagaagggaaaaaggaaagagagggaggaggaggaaggagagggaggggagggagagaaggagagagagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtggaagagagagagagagacagagggagagagagagagagggggagagagagatagagagagagagagagagagagagtttttatggctaagacagcttgctctgccctcctcccctcctgcttgtccaggctgggggaccctgatgagccagaaagttctctgggaagcagggggctggggagggggtgggaggctctcccccaccacacagctgacagacacttgagaactttccttcccaagcctgtatcctgctggttcggggcaaagtgtgcaggtttcccaccaggatcagtgaggaaacggcctggtttggactcaaacatgctgatttgttttctcaacagggccccagctccattcagggagccgggagatgcccgcttttccagggtgcctcccgctccctttccgagaacacatcacccagtgtctgtaaggcttctgcttcttgtttgacatcccttatttacaaagcaaacagaacgttccttttaacacacatcatgctaagtttattaatgcagaaaacaatcccaggaggccgacccgggggccccgtgaaacctgccagcacaaactcttcaaaagctcaggccggcagatcctccaggacaatatttcacacaatggagtaaaaataatatttttctttggacctttccagccgcttttgtggcgagcagacagaaattattttcttactctgctcccagaccagaactctagatgaagcagcgtttatttgtttaacacaatgatttcatcctaaatgtctcgacagcaaatagttggtggcttaataaagggcctttgaaaggaggctggggctggggaaatgtggggctgtggctctcaggagcccaatgggccagtctgctgagattgggttccccctcagcctgttggggagccctgtggggaagcatgctactgccccctggatcacaacacttacactgctggcacttggagaccgcaggagactgagaatttggtcccaaatggcaggccttctccaagatgggccctgccaaatacagatggacataacccacaggcagatactcaaccctgtgaggagaaaagagaacttttgtgttcatttctgctttcccctgattaaaaatgatgtcttctgtcaaccaaaagttggctgctattctgatgccagctgggacttctgcagccaggcctcttgattaggagaagagagagggaacatggccagcttaggcagaagaatcctccaatcaacagacacttcactcagccagctaggaccaaagctccctggacactttcaaagtgcaatcagacgtgtcaacaagaactccaaagggctgtttgcatttcactcttttccttgggaagaactggaaagggagtgaaatgaaacagagcacacagaagaaaaaccaggaggaagtgaattgtagccaactctccaggtgccctggccatcagagcctagccaccactacacagaaaggagggtgggagtatgtctcaggacacccagttgtaggagacagggcctgattggaaccaggcatctgtgtccatggtaggagaaagaggccagtcttgccctacagctgaatggcaagtctcattttggcaaccaggacttagatggaacatctcccctacttcatgactgaatctgattcagttcctggagatttggtgcctgaaacaacttatttagatctgagtttgttgctagtctcaacaggggagaaggactatgttctcacgtatagctacttctaacattaaatcaacactggtttactgaaggctgtattgatgaatgtgcacaagtataaacaagataattacttaggccaactcatgataacatacttctgttgattaattggtctatcttctcttagtctcttagtttccttttttctctatgcttttgctcttgttattttacaagatgaaaatatccaaagttgtttatttttgaagtttttttgggtcttgagcttcttgcatatcatgctacaaaacacagcatttaaatgactgtttgatgctatttcatgctgtagcttatggtgcagggtattctccagtccccatgctggttgcagtatacaggttggtcttgaggactgccaggctgtgtgggaaatatgcagaaggccctagcattcccaaagcaatttaaatctctttccctcagtcttacagaggcttcagattgcctccaaacccacagcttgacctgccctcagcccccctttcatcttttctactgtttatttttccttcttccttcccagacctgaaataagcagatattaactcttcagacctgcttggtattttacactcccaaagaggtttcacagaagtgacattatttgattgtcatcaaaaccctgcagcctgggcatggaggaatgacctccatttcacaagcaggaagtgtttttgagcctggcattttgatagtcactggaggagggacccaaagaaactggttcttgtctttggtagttcttagtccaggaattcagtagatgatggttagtcttatttttggcttatatgacttagttctaccacacgggcaaaaagtggctcagggaagtaaccttgcacacccttactttctggactccatcccttctaccacttggcatgactgatgaccattagccacaagtaggcccatccttgggaaggaagtcaggctagggagatggtggggatttcaaacccctggcaccctctagcacaagccccagtacaagttcctaacccttgaatcagcttctaaggggagtgagttggtccatctgttgaaactttcttaatgttggtaataaaatagatcatttgtcatttaatgaacacgtatttgtttgaggacaatttctgtattcttcaagaaggaaaaggaagtaccagaaaactttcccatgggccactttttattttggatgctttgcaaacattcttctgtttaagtcacaatcacaaggtccttgcatatgctaggaaagcactccaccaatcagccgcacccctggcctcctgctctgttaatcacttaggtactaatcagttctcaacctgtgggtcaaaacctcttgggggccaccaaataaccccttcacaggggccacctaatcagaaaacacagatatttacattacagttcataacagtagcaatattacagttatgaagtagctacgaaaatattttatggttggggccaccacaacatgcggaactgtattaaagggttgcaacatcttgaaagttgagaaccactggcttaggatctacttatcacaatgagcctatgaactgtttgcttcatcagaggcaatggtttggatgtcccatttgtagacgagtaatggatgctctgagggattaggcaacctgtactctgtcacatagtatgaaatggaattgaaatagaaatccagtctactggctctagcactgtccattttccaccactgtacccttggtaaactgtatacatcatccaggccatggggaactattcagcctccatgggtatgacagttcagaaacttcaattcatagtgcactgactagcctcccattcatctttgtctctttacagttcctagcactttgccatgaaacagcccttgctggttcttcctgattgtttgggcttcctctgtcttacatcatcacttgcatgggactctagagcatgagactgttaatctcagggtcgtgggttcaagcccctgttgggcaccaaaatgttgttggttgttttattctttactctttgctctttttgtggggcccgccacccagctcccaagtaaaacacagagtcttattattacttataaatgcccagccttagcttggcttgtttctttccagtttttttttaaaacttaaattatcccatctaccttttgtctctgggcttttatctttctctatttctgtatatcttttcatgccttcttattctgtgtctagctgtgtggctgtgtgactggcccctttttttctcattccttcatatcacttttccttctcttaattctctcagcctgccagccccacctatcctttctcctgcctcaatattggctattcagctctttattaggccatcaggtgttttaaatggtcaaagaatcaaagcttcacagagttgaacaaatgcaatataaaaaaaggcaacacatctttgcatcactaaaacaaatgttccacagcataaacaagtgtaacaggccttgaaataatattccacaacagggatctgattcctaaagaggagagtatgctactttaaggactgctggactattttctgcgaaggcagactgtgcttgcatctcagttccatttctgactagctattgacctagtactgctgcctaatcactcagaatataatctgttcctgtgtaaactgggcattcactcatccagttattttcagaagaagctaatacaaaaactaaggtcaaattttgtcactgtcccttgtggacatgttatggtccttactagagatccagcagcaggagttgacagcttttcaaggagctgcctcttgaagccttggaacacccatgatctcacctgatgccctgatcctgcaggagctaattgttagatccagaaggaaaaattctttatagtagaactgcctgcttagcacacatgtctttgaattgattacatagttcatcatacagatgcctgtgtaggaatatagacccttggagcttgtatttcatgtatttccaagatgtacaatgttgtaagatgtttaaaacagaagtagatgaaatgaaatcagagttgactaaactgattttgctctttctgatagtgaggtcgtgttggtaacacttgtattgacataagaacacattacttagcaaaggtttagaagcagtctctgggaatatccagttgatgccaaaaaaaccacagcagtgctgtgtgagcaagaaaattgattcgtgtcaagaagagttgcttttggctctggaggatatttgaagtcacttcttcattctccccctccatcctgtcccaagatacacttgttcaagtatttggtatgcctggatctgactaataccagcaaaatattttctggactgttctagtatgatttctttgtcttcatcacctaagtgtgagtcttactgaagcagactttgagcagcctgcctgcttggagccttccttcctttctttcttccttccttcccttccccctccatctctttcttcctcccatttttcattccttctttccccttccttccctcaccttcccccttcctttcttttttatttttagatggatagaggttttccaaacagtggttttattttgaaacttgcagaaagtaataccatcctttctgaaatacttgttttggatctcaaaatgtaacctgatgctcctgatcagcattttctcttcatggaactctgcctttatctcgtagcctccttaagttacccagtcagcctgaatcaaatctaacatagttccatggagtttttattgtagttcaccttcgttgacttgcaatgtgcattcctaacatgtatgtaaatgtaaatgatatcattggttaggatactgaacagagtattctgatttaacacctggcctaaaataccacactgttttactcagagcaaccaggcaacagagttactttaagacctcaagttcattatcatcagatcattttaagctctgtgacaacttttgacaccttccatatctatcacagatcaaaagaggatcctcaaacagaacaataacactgagtgaaagttacataaagtctttctctattagaagagtttattttggccctccaaatatcatcttttatggattcccatagatccctgtgtactagttgtttttctattactgtgataaagttcatgatcaaggcaacgtttaaaagaaagcattttattgggcttatagttccagagagtcagtccatgatgacagagtgaaggtgtggtgacagcaacatctaggaaggagagtttacctctcagacagcgagcagtggcagagagaacactgggaatgacacaagtcttttgaaacttcaaagcccatccccagtgacacacctcctccaaggctgcacctcctaatcttccccaaacagttctaccaactggagaccaagaactcaaatagctgagcttatagggccattctccttcaaaccaccactcagtgattcttcatagttggagtttcaagcctcatagtgattttcttggttatgttagttcttaaaaattcagaaaaaatggctttcgatgttttacataaaaatggtcataagtaggctccagaagatggagaataaaaagactagccagctcagaatttgagggcttcttctgtatattgtttgatcacacacacacacacacacacacacacacacacacacacacacacacaagacttagagttgaaaatgtccataagtgtagtgaggaaatgccccaacaaaagcctgctttctcaagccaccagactagtaaagctgtaacttaggaaaacagaaaaataaacaaataaatactgttttcaatcaaacaccatagaagaaatttcagctttatttcatcgtggcaacaaaggccaacactcccaggcacacaggattctagtgaagcactccagtccctcatcttaatggagccagaggaggtcaaatataaagccaggactttgatcccttgtagttataaacaatccctgctctccaccatgatgtcattgaggacaatatggggaaacaggacttccacctcaccagcaatagtaagtcacccctttcttccccactcagggtatcaaggaggctaagtgagagtcaggactttcacaactgcccaatgataacaaatctactccaattaaatctcagcaacatcccttggagacccagaactcttatatccacccagaaataatgaggaccaccccactttagatatcagtgttgggcaagtgaggtactgggcttctacctccacctgttagttacaagctgacctttgttgctacagggcctatgggagaaagactcttaactttcaagtccttagcaaaggaaagatgaaaaaaaaaaggatgaagaggagctaagaaataacagctgaaattttctcaatttttctggtgaaatgactgtgatcaacacacacacacacacacacaattaggaacaggaatacacaataaattgttcataatcaaacttctgaaaaactaaagacaaaagtcttgggagccactagagtgggtaaagacagcttgcttttaaagggaagaccgaaggccagggagcagctaataggatgaggatgaagtggctccctgaagaaggatctgcctacccagatcttacatctagagaaaattgaccttctgaaaaaatggaaagagaagtatacccagccaaaggaaaatggagagggtctgtcaccaccagatctgttgtgaaaggatggctgtcaagaataatctagacaaaaaggaagtaaatgaagggatcttggcataccaggatgggaacacacacactaagcaaacacgtttgtgaacaagattcactttccatagtttggatttttgaattattcttatttttattattatcaaatgacagtttggaaaattaccacattgtctgatatagttttaagttatatatagaaaacattggagtcatttacgccataaataggggacataaaaggaggtgaagtgataacaggataccacagcctgagttattcataatagatagaaatttgtcacctcactgctctggaagctgggaagtacaaaatcaaagtgctggcttttagcaagggcctccttactgtatcataacaaagcagaaaagccaaaaatgagaggaagagaataagtgatgagattattccatcacaaatctacttctgtgatagccgcattaactcatacatagggggttcttaaggtcccgccccttaatactgttataatggcaattaaatcctaacatgacttttggagaggaccagcattaaaaccacatcataatgttcctatctgtcacttgaactaatgaaaagatggagtaagtagacagaaacctactacaagtacatggtatcctatctacagaaaccactggtgcagtcacactaaaggtataaataaatactatacatggctcagattgaattctacaagaggtttaagtaacaggaaagacagaaaagaaaagcaaatacaaaacaaagaagaacaacaataaaaagacataagaaccaatcgataaaattatattaattataaatgctccaattaaactaattaagagagagagagagagagtagcaaaatggaattaaaactaactttgacctactatattctatctatgagaagttaactgtagctacagaggggctggggagataactcagcagattagagcacttgttgctctcccaaaggtcctgggtccaattctcagaaccaacatggtgactcacaactgtctataagggagtgggaagaggctgggagtcatagagggaggggaaactgtaatcaggttatattgtataagaaaagaagctatttacaataaaagaggataaattatctataaatctagtctcaggggtctgataccttttttaggcctttaatggcactgcattcataatatgatgcacagacatacatgcaagcaaaacactcagacacataaattaaaactaaaggaaaattaaaataagtaagatatttattttaaaatatgattataggggaaatctgaaaataaagactgcatgagacattatgcaaacattaaccaaatgaaaacatgaggatctatgttaattttaaataaagcaggctgtagagcaaagaaaattaccaaagagggacattgcatagcaataaaagtgtcaattgaagaagaaaaagaacctgaaaaatatatgtatcaaccaatagaactatagactatatgattcaagaacatctagccctgaaaggaactgaaaatctgtactgtagttggaaatatctacagccttgtcaactgcttgcaagagaaaaattaagagtctcatggacatacaaaccacattaagggcaggcctcatgcctagcagtatatggtcaacacaaaatgaattcaatgttattttttgaaattttgttttcttttggtctcataatgtgttgtttgggcatttttaccttactagtctttgcttctatattatgattacaaattttgtgtttttatggtgtgtgtgtgtgtgtgtgtgtgtgtgtgtgtgtgtgtgtgtgtgtgtgtgtatctcctgtttttttctttgttacttttctatttgtttgttttgttttattctggtttggtggttttttttttatttgcctgcctcttttctttttcttctgtttttatttttgttttcattttaagtttttggagacagggtttcctctgttgtagcaactctagctgtcctggaactcactttgtagaccatactggtcttgaacacagaaatctgccggcctctgcttcctgagggctgggattagaagcggggactaccattattttgtgtgccttcttgtttcctaaagagaaaaagaaaggctgggcatggtggtgcatgcctttaatcctatcacttaggagaaggagacaggtggatttgaaaccaacttggtctacacagtgagtcccaggacagccagagctacataatagagagaccttgtttcaaaagtgtgtgtgtgtgtgtgtgtgtgtgtgtgtgtgtgtgtgtgtgtgtgtgttgggggggtggagttttatgagtcgggaacttgggagaatctgggagaagatgagggagagaaaaccatgatcagaatagtgtatggaaaaaagtacattgtaaaaatatatatttcaccagaaaaacaaaacaaaacaaataaaatgccttaggtccctggttgcaatgattaaatagcctcagacctttaagaacaaaaaagactgatagaaggtcaggcgttggtggtgcatgcctttaatcctcgtactcagaaggcagaggcaggtagatctctgcgagtttgaggccagcctggtctacagagtaagctccaggacaggctccaaacaatatagagaaaccctgtctcgaaaaacaaaaacaacaacaaaaaagactgatagaaagaacactacccatgaaattagaaagactagataattataccactattggccaacaggctataagggatttaagtcatgcagagtatgtatccaaccacaatgcagcaaactggaagtgactctttgacatgctaccccaactcaggaccccagtcatctctgccctctcaacacagtccttcagctaacccagactcccacctcccctctccatgtccacagacctccagcgtttgggttgagttttgcagtgttgagaagctttttatttgctgctgggcagcagtggcagtggttttttttttcagatttattttatttttttaattgcatgtatgcatgtgcatgtatgtgagtgcaggagaggcagaagagtacagaactgtcattgtgggacagccacccctcccgcacaaacagctctatgcacaaagatcattcaaaatgaagtagatttttcttcatatcatgtgcactgtctaggtgctgagctctgtgttgaccattctaagatatgggttaaaatagaaagaaggcctgactcctgtgaaggaagagcttgattcatggtttgggaaaagggaccacacacataaagtgtgaaatacgtatagggcattagtatctaagctacatcatgtgatgggacctgcaatcagctgggttggctggagtgagttctgcaacccctctgtttatgcttgactagtctgtcatgctcagcatgggacctcaaagtctgaaggaaaaacaacgaggattggaaaggagacagaataaacataatatgaacttctctgtgatattcagcgtcaagaaatatcatattctctttccttgataaaataaacctggtgtgtgtacctcctctcctcagtgtcgagagccccaggatcagatgttgggggggggtctacaacctccctctgggaagaacctttgggctttctgggcaccaggcaactgtccacatagaggagatgacctccctagcgtctctatatattagcttggtctcaggagctgtcactgaggagttcagagtcacatgagtcattggaacagtgtttctggttctacctcaaggtcccttgagtgggtggaccaaagtgtgtacagacatctgtgttttaggaaacagtgtctccaagtcttggggatccctcttgccaaccttaagctcatggcacccattctttccttgttagaccctcagccatcttccccagctcaggtgttcatctttgaaaccaaaagcccaagaatgagttacctcctgggaatcctgtgagccaccactacattcagaaacaaacaacctccaagcaaacaaacaaaggaagcaaggcatatagactagtgtatgcctacaatcccagctcatgggagacaagattcagagtcataggttcaagactgtgtggggacctagtgtctcaaacaaaacaaaacaccactcccaccaaaaccaatcaacaaatagtaacattcataaaacaagacttttaaacctcctctcagcactggtgtgcacacatgggcaagcacacccacacccacacactgggtaatcaaatcaaggcctttagaaattaaagacttcccccgttgaaatagaagatctttaactaaatgtaacacaggaacagtaatggcatgaactgtttcaacccagaccctggctcaaccattcattagtccagcaaaatgacttgcttggttttgttttttgttttgttttatttttttttcttgtttcctggtgttttttgttttttttgttttgttttgtttttgtttttgtttttttttgtttcctgcaaattggggatgaagaccaaatcatgggctattgaatggctattgatttaaggttggtaaagtatgctaactacagaatgctaaggctaatagaacacacagtacagttttaacatgggttcatagacattctagaagcatcaggggctcactgctctgagctcagcagtgtcatctgaagcacagggaagatggagggtgtgctgctgaacttgagcaaggcattccataaggaagcctgtctgttatgggctacattgtgtcaccctttgaccctgagttcactggtgaggctctaacctccacgacttcacagcagtcctgtagagggtggtgagttaaaaccaggccgtcatgctggtcctaacttgatctaaacaatgtccttgtaagaagatagtaagaccacagaggaactccaggggagcatatgcacagggcatggcgatgccagccacctgtaagctgaggagagagacctagaacagatcatgcactcacagctcctggaagagactagccttatcgccaacacccttggctcctagacttcagaactgtaaagcccacttagcttattaattatgacaacctggagcatcatccagaggtatatactgtcaatgctacccatccctgaccctcaatcaggaggaggattccatgatacgagatgattcgtagcctgtaaggctaagatatctttatttagataaacaccagccaaacacaagccagagtgtgccaggggcagcaaggcagggaggccagagagaaggggttcccatgtgccttgctgccccttaaaaccctatcacatgtcatcctgacctcaccttgaccacgccctgacaggcatggccaggcgcacctgtagccagctctagcaggcgtggcttacactgtctcctacaattccccttttagtctaaaagaggattaaaacttaacagtgtaaagtatccaaaattaacaatcataaaggtgaaatacaggaagatacaataatatgctatgacacatcctaactatgtctatttcagctaaaccctaaagtcatctgaaaggtggtatccaagcctgaacgcctccttccaatcccaaccataaacagtagtaagttatccctgactaggcttacactaccctaatagacaataatggggcaaaggggtgtagcatcttccaagttacttcctgctgaaatgggacggtggtagccttgtggagttctgtgggaagaaaatgttagtatagtgaaagtttctaatggattatatccagtccatattagatgggatttgcttgattgaagatctaggttgaaatcctcaacttgattgaaatcagtacccaaagctctggtcacagtgtcagttgaaatggagtaagttgtatccagtgcagtctaggaggtatggcccaatttccttccagagcgtccagggattgctgtcaggcaggtcttcattggctgtgtgggactcaaacataagtgttagcagagaaatgttttattgaatatgtgtgcatgctgggaaaggcaaccatggaaaaatgattatgagacggtgtactttcttgaagagtcaagaaagacaaagacagtccccaaattcttctctcattctgtattacatcaattggcttcttgatacaatacagaaactctaaagtttagtaaaagccaaatccaactctaaatccagcattgatttacttgaatagggactagaaaaataaagagaaatagatttaatgcatattttactatatggcacattccttttgtttgatggtgatagctaccttctcttcttaagcatctatccatggaacatgtagtgttcttagacttctggagataagttttcctgtgaagatagaagcaaaatacttccctttcctttgggaggtttctattcagtttactagatgtgcctagtaaaatacctgtcacttgtccttgtggagaggtttgtcttatggaactccaatcttaatcaactttgatggtatccaaagtttttcttctcctgtggaaacaaatgcaaaactcctaccccaacgtaatacatgtcctggtttccatacagaggttagtacatctttgaagtatactggctgattcacttcagcagtttttccatagtccagtgtctttctgcagctgtttgtcctttttcattggcattaagaaagtttagtgtcaataaagcatatgcaacctatgtttggggggttttgtcttcccagcctgtctatggagcatctccttaagtgttctattagatctttcaaccactgcttgtcctctaggattgtgtggtatactggtgacatgctttatgttataatatttgaaaaaccgttccaattttgtggagacaatatttgaaaaactcttctatttttgtggagacatatgccagagcattgtcagtttttatctgtgcagatatacccacaactgccatcacctctagcaggtgtgtaataacagaatcagctttttcagcgttaagaccagtagcccattggaaccctgagaatgtgtctattgcatgatgcacatatttcaaatttccaaattctgtaaagtgaaagacatccatctgccagacctcattcctccgaatgcgtttagaactgtagcctgctggcaatagagtttggttataaaaggaacaagtaggacagtttttcactatctccttggcttgttgccaagtgatgaagaagtcctttatttaaacctttgctatttacatgatgtttcttatgaaattctgaggcttctagcacacttccaattaataaatgatcaatctcatcattgccttgtgctagtgggcctggcagacccctatgggatctgatatgtgtaatgtatagaggattacttctgtttctgattgtttcctgtaattgtagaaacagtgaagttaattctgtattatcaggaatgaattctgcagtctcaatatgtaagatgactctgcatattgggaatcagtaactatattaagaggttctgtaaaacccataagcaccctgagaattgcatataattctgccttctgtacagatgtatacggactttgaactattttacttacctcacgtgcttcataaccatccttacctgatttgttggcatcagtgtagaaggtaagaactccagaaatgggagtttgtcttacaatatgtggaagaatccagactgtcttttttgtgaatttaattctgtcagttttgtgatagttgttgctaatcttcccaaaaagtcaacaggacagtcccactgtcaacagtaattaaggtttgcacaacattaaacatactcccattttcaaccatgaatgacaattccccaccccacaaacataaacacagagtcacaagtttggaaacgtttaaaaacatcacaacagcagagttggagtggaaaattcttgggggttctgtgaagggcaaaaatagttacagaaatggaagtcaccctctttggacatgggctacatggaggtgggctctgtccatttgtcctgtgctttttaatatcagcactataaagccagtgatgcctaaaagtcaacagaatgcttctgagtgaatcaaattcatttcctagttaaaaagcaataaagtggggggttgcaggggaggggagggagagggagaagggagaagggattgacatgtgaagcaagattgttcctaatttgaactaataaaaagaaagcaatatagtggcctaatcaaaatagcattagtttgagtctggggagtgacttagtggtaggtaaatgcatagcatgtgctcgggtaccctgggttcaatcgtggagtgtgttaacacagttgatatcccaagagtgaccctataaacactagatatcttaggttaggctcaagaaggatttaaactgttgcaaccctgacactgcttccccaaagcttatttccgaacccgctgggatttgagcaaaggccagtgatatgagagtgaagtctgctgtgatgggagaaaaaggcatcaatctccatgcaggactggggtaagagggtctattaatcctgggacaaacttgaattctgcccctatgtggaattaggtaatttgcttagcttctctgaacctcgatttcgttactggcacagagtaagaaggcctgcctcacatgtttttctgaagggctagggaggaaagcaatgagtgttccacacagagcagggatgtggggggtggaaggtgtagtcctatgtctctaagagcccctgtgtctctcctgctgctccagggcagttgtcatcctcatcacatggctctggagagtgacatttgtagatgaccagggcagagttcatctgtcccaaacagaaagccacaggaaaaatcctcacaggcttcagtcctctctcataggtcagtgtccaaatgtgggtccaggaacccagggttccagatcaactgtgggggaccctttgtaaatggtctctgtcttggccctggttgaaaggacagccactttacagagtaaaaaagagggggtaggctctgtgactcattcttttggggtgagacttttaacagtggggagacattccaggttccagacatatttgtaggtcctttgtaagcttcaatgagtagtttggggaccattcaaaaggggcctgctccacattgggatagagatatgttcatggctagctttttcttggcgtaagcatagcttgaagaggtaccatttgttttcagtcaaactgacatcatattccccctaagggggcaagggcagaggggctgccctggagcaattctccagcacaactccagagcagaaggcccccagccagctagctggaaagtctgggttctaggcccatctggtcactaactgactaagtcctctccccagatctgtgtattttctgtctgtgaaaggggtgggaccacccaagatcattgaattgctgacccctgggccaaatccaactggtaatcgtgtttgtcttgggccaacaaattattcttaagagactcgtttgcctgctttggaaagggtgtgtgctctccacccagaggctcgacaccctgggattgtgttatatcagccggatcctgccttaggaatctgctctatccctgcaaacatctgcagccatctcgctagggcatcttagaggcttccagtcaccggctctcctggttctgtggttttcaatggccccttctaatttccgccgctgccacattgccatacataccaccctccataaatatttgacaatcccaccttttgagttaattattcttttcagaaagccagggaaataaaggacataactccctgagagaaaatgaagagaacaacagctataaatagcacagtggcaggttgatactcacccccacccccacccccaatctccctgggttaggatggtctgatacctgcctggtagcctggtagccggggctgaggctaagtgacatcagctcagattacatacagagttgcagacttcacacagtcaagcaacgcgaagcctgggccacagctctgcagaccagacaggtgtgtgaccgggaaggcatgcctacacccacaccttagtgcagccagaaacgacaccctaccactgcacactctttccaaaagcacttgtgccataaatagatgctccctactcttcttggggggtctgtgcactgagtccttccaaccttccataatgtcctcaattcatgaaccagataaacagagtttaaaagacttcaaagcaaacactgagcagagccatccttgactcattccccagtgggcccttttctcgttgtgtaaccaaagagcacttgacagaagacacatatctcgagaactagattttgttggttatttatttttttttaaacctcaaactttgcagtattgggataattacggcttcgtggagttgactactttaagctgtcagtcatttgaatgctgtaatcagtgctttgtaatcacaagctctcttcccatctccagccctaaataaaacatgccacaccccaaccgcctctacttcagagcgttccaccctaagcacaccttaccttaccttaccgcccagagtgctccaatgatcggtcttttctcattctccgggactcctcccacttcatgccgtggtcctcctccccagagaaagtctatggtcctcctccccaagaaagtctatgtcacctgagagaacaagaaccaatgtagaggctcaggtttgtctcacagtgcaagaaaagtttgggatcaagacatgaggaccaaatgtgtggtccccaagtctctagagtagctgaggcagggaagacagtgaaggcagagacttgtccatctgcatcctggcatccagatcgatgctgggaacacaatgaggtggagattttgtaaatgttagctgagtcaattcctgaataaaagaaggtctgagacacatcctatcatgtgaccttcaaaaagaacccactgagaaaaaagcaaattgcaaactaatatggaagggaaatggaaaagaatatgtgtcctatggtatattttgctttaaattttaaaaatttcattttaaattatgtgtatgggtggagtgtatgtccaggtatcaagagaggccagaagagggtagctgtatgtatctcctggagctggagttacagtcagctctgagctgtcatgtaggtgctgggaattgaacccaggtcctctggaggaacagtcagtgttcttaactgctaaaccatctctccaaccctagttgcgcaaagttgtactttgcgcaactaggggttacttcccaagccactgactttggggtgagcagaataccttattttgcataatgcacacattcttgaatcattcaaggtcagggaacaagcctctattacttggtcagctaacagataaggatgtgttagacctcgattgaaatacatcagctctctgatacgtgattctacagaaaggggattgtttagttcatcagcactgaaagtcacagtttcctgacttcagatttaaaggaattctaagtgtgtgtgtgtgtgtgtgtgtgtgtgtgtgtgtgtgtgtgtatctttttaaaataccagaagcaactgttagtatcctcagagggcagaggcattggtagaattatgggcatttgtgagcttcctaatgtgggtactgagaagtgaacaaatcctgtgtaggagctgttggtatcctgccttactcactgagtcacctctccaggcccagcgattccctaacttttataacaaatgacctctctccaccaatgccagcggtgagggcttaaaaaaaaatgctactaaacatgttaggaagtggtatgagctacatttagactcaatatttatttgctcaataaatattcattgagggccacaactgtcttacgggcttttaagtaaaacagaaactgtagacagaagtcagagtgggctttttatagtggcccctcaagctgaggagtgtcctaagaggggttggctggtactttaaattcttcatctcggtcgtttttcctctacctttgtcatttgacaagatgtggtcgtgtgatgttttcctgtaaattcgtcataactataaaagcatagtaagtaacacagagacccagcgtaaacaaagttcccagtgagaacactgctgcctcacagactttctccttttctttttttcattgcagttttaagccattaaaatatttgctcgtgatttatttttcctgaagatagacgtagggactggtctatttttcacatttcagtggagtctagttttaaaaatactctccttgaccttgtggtgaaatgtgaattaagatacttcctcctactgccctgtgcgaaagcgctattcatcagtgggtgttttccagcacatttcttactctttcaaaagtgtaaacacagcaaagccctttataatcaaggagtgatgccatcccagtgtgcacttggaaattaacaacagggccttcttatttcccataaacttctctcttgtcggctaattcctccccccaccccccacccataccaaacccataactatatcaaacccagggctaaatcaagggaaatgagacgtgacctattaaaaaggaaatgaataatttgagaggggaaaattacatctgtggctggaagcatggacatcatggcttagctgtgcaggtttattctaccactgtacccagtgacttgcttctgggtggcacctcctccatcatcaaaattacctcatgacgtcagcaaaattagtcaaattgtgtttagatcccatcaacttgaattttttttcaagattctttccatgggtcctttttaaattaatgaatgtatacatagaagccctcttggaatagttgttagatcccctagaactcaagctaaacctggacttaaatgatttgtgtaagtgggctcatgggtcaatgtttcattggtaaaattattagcagaattccttgtgccttctaagtagcagtgaaatcgaccttgtccctccctgtgagccttgcaggatcgacaaagaaggaggttgggagagccgagaccttatggatgcacggtgctgccaaagttcaagtctaaaagcagcctgcagattggaaagtgtcacatccacacatcatgttaataagtaccatcatcataatcaagatttaggtggcttggctgagcctcttcatgcttgggtaactatgtttgctaagcttagaaataggtctgatagctattaagctctgcattccaggcctgagccaatcaaatttactcctttaatttcatgattatggagccgggtggtggtggtgcatgcctttaatcccagcactcgggaggcagaggctggtggatctctgtgagttcgagaccagcctggactacaagagctagttccaggacagcctccaaaagccacagagaaaccctgtctcgaaaaacaaacaaaaacaaaaacaaaaaagattcatgattgtgaacaactatatgtcagcttcctaagaagttcttaatgctctaaactgcaaagaataagaacattcaggaattgaagagtgggtgaggaagttacagtccattcacagaacaagggtgctaatgttcaccaggatctgtaatagacacttctagtcagcaatggaaaataacctcaacatgggtgaatctcaaaaacagtgctgttttcttttaagatacaaaaagagaacatagtacatgatttcatttggatgaaattatagagacagcaaaaactacttcataacggaaagagaagctcaggagctggaatggagaacaaccagcttaaggacaccaggaagtgtgtgggtgatagaaagttctaggttgtgattgcaagggatggcatgaggatgcaaatgttggagaaattcatcaattgtgccccaaatgggttttattttacatatgcttatatgagtgtagaggtgtggtcttgttggaggaagtgtgtaactgggggtgagcttgaggtttcagaagttcaagccagttttctgcctgctgatctggatgtagaacttcagttacctctccagcaccatgtctgcctggtgctgccatgcatcctgccatgataatgtactaaacctctaaactgtaagccagccccagttaaatgttttcctttataggagttgacatagtcatagtgtctcttcacagcaataaaatcctaactaagacgatgagtatagttaaaagaacagctaaaaagtatcaataacaagtgtgtagcctttgagtgccatcctggaagactggaggagagagatctgaaagggtgtagcctggccttcgtcctcttcccagctatacgggaagatgggctgaggaaggaaaagaatgtgttttgttttctttactttgtgtccttctcataagcagtattaattttatactaagttgataaatgataaagtcaaggtccatgagagaagtcgcccttgccctagctgggtgtgctcactcgtatagtataagcttgcttccatgtgaggtgattgtgtataaacgcatgtcatacagcatgccttaaacagggtgagtctacaagactccccagggctgaggctatgggctcagaatctgggttgggtacatttatgggacctcagcttccctgagcagaaaatagcagggtttcaaatacttagccatgggaatagctgaggacaggttacaccagctgtggtggtttgaaagaaaatggcccccatggggagtggcactattagggatgtggtcttgctggagtaggtgtggtctcattggaggaagtgtcaccagagaggcgggctttgaggtcttatatatgcttatgacatgcccagtgagacagaccatttcctgttgtttataagatgtaggactctcagctgcttctccagtaccatgtctgcctgcaagacacgatgatgcaccatgatgatagtggactgaacctctgaactataagcaagccaccacaattaaatattttcctttataagagttgctgtggtcaaggcatctcttcacagtaatagaaaccctaactaagacaccaaccttgaataacttcccagagtgttaaaggcagaattagagccttttggaggttcctaaagaccgtcgctgatttcagacccttttcctcctatagcttttagtattttattaccaaccagtgaacaacaaaacagtctggcccttctccactgggttaatgggcaagtccttcagtcaattctttcattttccttgtcactgagatttggagtaaatcatagacagggctgtctatggtggccagacttcatggtgactgagacataaagatgaaaagcaagtagacacctcacacacaaacaactgtcgccccccccccaagtttctgtgaaaaccttgggggccagtaggaggaagggtactcagttaaaattgcataagcccaacagaaaaactaattttcagattagcttgccatgtgttatgcttctccaaatggccagaagcaagtttgaccgggctgtgtctgacaggctggtttggggaagcctttgaacaccaatgcttgtgatcctgcagggcctgggactaaccgacccatctgtgtactgtccacttcggaaagagaaacttccctgatggcattcgaaagaaaacaccaagtaaatcccaaaagggtaactttaaaccaaagcccaaccaagaaagagaatgggagagagactggcagctgaggccgggtagaaataaaagttccattgtcctgacacggatggtggctccccggctgccagccacactagcatgctttgccttgtggtttgtgtggcacacagacacttttgccctggagagcacattccagtgtcagagtgtcaggcggccttcaccccaaactcttcagtcagtgggggaactcacactagagatgggaggtcacagtgtggaaaatcattggacactaatgagcctggcgctgtatttaccaagaaataaaggagcgatgttacctgaaagtggtgtattcatggcaagagtcaaggaaaggttaggaatcagggagcaaggaagaaggggtgtccaagttcagctaaagctgggacatgggacctgcctctatgaatcagcccaggttccagattttaatttccctgtttacacttgcccctgggatcctggaagcaactaagaaatatccccatagccaaggccacccaacagctgactgctagtagagtctgcctgaacatccgtttgcttaatagagagcccttctaggagcaagaagccctgaaataaaggtattattaatttatttatatttattttaggataaatggtttaaagagcatgtatgaaaccaaatgcaaagcacctaacggttgatccaagcattcaatgggattgaagttaggccatcctgagctacctcaggagttttaggccagtctgagaccctatctctcacacacaaaaatactcagacccctaacgggggggggagaagggcaaagtgtgtttgggggtagggggtcgacagaccattgacagaagagggcagagtggaaagaagctagtgtgaaagtcaagatgtcacctgatgacaaggaactaaacctctgaactgtaagccagccccaattaaatgttttctttataggagttgtcctggtcatggtgtctcttcatagaaatagaaaccctaactgagataattggttttaacaagttcaaacagtgcatataactgagtgtctagtgtgtgtgtgtgtgtgtgtgtgtgtgtgtgtgtgtgtgtgtgcctgctcacacctattcatggagaagagcttaaaatggcgagaggataccttgagaaacttactaatatcaatttgcatgtgtttcagactgagccagtttttcataaactcatttgaagaatctggcaagacatctgtattgtgaaaactgataaagatgactttcgaatactacagtgcaggaatacagccgaggcaggaccatcatgggacaagagtgtatgtgtagtcagcaatcactcagaggcatctatatgctcatatagtcatccaaaggagggaataccacatccatttttgtttgtggaactgggggattcacagttaactgagaataagaatttcattgtagggctggagagatggctgtgtgatgcagtctcttgcagaagacctgggtttggttcccggccccactttgtacaatcacaatgtttgtagctctagttccaatatgtgttggcttccaccagcatctgcacttacatacatgaatacacacacacacacacacacacacacacacacacacacacacactccatgcactacacttgtgcacacacacacacacacagagaattaaaaaataaaaacttatttgcattcattgttgtgtcttccacagaagtatctttgtgtaatctgttaagagtttgcttactcaatgaatacctacctccaaacagacaggactttttttcttaaagataaaaagatattgaataaggacagatagtatacatgtagctgcaaccaaataatgggttcctagaacattagccaaaatgacccttgacctatgatctagtccaaccctctcatttcacagattagagtctaaataagccatctgaggtcacaaactaatcggtaccagaacctggcatccaactccactgacttttctctctaaaccaccatgcctctgagaatgaggaagcataaataaagaacctcagcccttatatatagtcttcctaacccatcattatggagggagaagacctcagctgttttaatcaccacctgcagaagtacttggcgatccaccgcattacatatttggcaggcccacgtgaaagacgcttgagggctcaggcaagatgagaacgtccatggaatgctttttatttgtaggttggaactgaacactctgagctctggccgctggctttcgagagacttcaggcttgccgctttaatgcttcagtgagcagcaaattggaccacaagagcgtcaatcacgcgatcctgccaagcaacaccctccccgaagtgtgaagttctgcttgctcaaaacagctccattcatagcatgggtgtggaggaaccctcaatccatgggttctatgtcccgcaaacatctgcccctctatgtgattcttcaaagctgagtttctgagttgtggccaggtcacaagcaaccaatcagatgcagagcaacaggctgctgctgctgctgctgctgtccgagtgggtggagcgagcagtgaccagacagcattaagacacagccaggaaattagtaaggtgcaaattgcatagtggtggctgcagggcaagaggaaaattgcagaccgttgcctgaagagagagagaaatggctgggtggtattttagaatcaggcaacagggagccactgagcatagttctcattggttaagggggaaaaataagtaacagctcataaaacggaagtacagtacgccaacagaaaacttcagtgatcctagagattcaacgcctgcatgccctgtaaccttcgcctaggtcaagacagagagcgccctcttgtgttcactcccagtcaccccacccaggggggaagtgccattctgccttgtgttttcacataggccaaaatggcaagccaagagaagaccagttagtgaagtccttgatcacccccccccccccagctcagctgtggagacagagcctggcagcctgctaaccctgcccagcaactcctctggcatgtgtggctcttgacgggatcagattaggagacccctggaggacagactaggaggggacaaccttgagttggccctggggactcacatctccttgaagagccagcttctcccctgcagagtctgagggagggtgtggggctgctcacagagggcttcttacgtttcttttcttttcttttcttttcttttctttccttttctttctttctttctttcttttttttttttttttttgtgtgtgtttctgtggtttcttcttttccctcatttcaggctgtctgaatttgcttagagtggtcaaccatcatggagaaggagtatagactgttttgctccaggagtttcctgttaggcaacaaactcaggcctgcaaggcttggcagccacaatgctgatttttgtggcctggagttgtggctggatttgcttagcttgccacctggctgcaggggatgatttgaccacgagagtagcaagtactgttccggagaagaatcaagcatgctttaaataggtttcatattctggctgtgagcttgggcttggctttcctccagtgcagtgtcttgtacactagtgtgtgtgtgtctaagaactccatttcaagttgagcatcaaaattaacggccatttctcactttggcagatgcccagaaactgaatacacggaagattaacatggcccctgtcaaggatgacatgtggattcgtgaggcagtctgtattataaaaataaaatgaagtggcagttagattccttttgtgtctcctgtgaggtgatgaggggatgctcatggcctcaagcaagaacaagcttcccaatggtaactgcatccttgttttgctggaaggagtttgctttgcttgcctccatttaatattcaaccctttgcagttcaacttccctgctaacgcaacccaggacttcttagatatcaagtccggtgaggacttttctttaatggcaatcttaggtcagtcccttggtggagctggcactgctgacccgtcatgtttcttttctgttggccaccagaggatcatctcttcaagactttctcctttatctccaggtcctccaattctgtcccttttgtagtatctccttctttcacttgctatgctggctttgggctctcccaggcttctgtgcctagttcccttctgctctccaccctcccatgggcagtcaccacatcaacacagctccagtctcagatgggtgcctcaggtaatggtctccctgtaaatctcctgctgactactggcctctgtgtgaccttaccttcagcatctgcagccaccactcccaacccagtagagtcatggtaagtttaaagaaaaatccctgagtagctgttaccacctgagctggtagtgtcatccatgtgtaggccccaactcaaccaagggctcatctttggacttttcttcatctttacaatgttttgaaaatagaaaatgtatttcagattttcttttctcctaagccagcaactcacagtagagccctcttgtgctactgggcagcagcagcaaactgcagttctccatcagtcatgaagtcacaaggggaaaatagttgatactctggtataccacattgctaagccaggatatatgataggctaagtatagaaagtgcattgttttgcttacactgtcccagtgcatgctgggatatctggacagcattaagttgaggagcaagcataggtagtctaatgagtagtcagaaaccagagccctgaggcataacgtgcacatatgcagacattgaaaggactttgtctaggaattctcctccaggacagtaaatggccatgctggtcctcactcttccagagctcttaggcatatagagtgactctatgacccacaaggaatggaactggagaaacggaaaactgaggtaatgattattacctgactcagaacaccagtcctctactcccttccaaacacagagctgctctgatcctacttacatcccagagtgagttcggggagttttgaaaggttcacaggtcttcacatatttactgacttcacattctatagtagaacagcctataccaaatgagcagaggggttgaagacagtactagagactctcagagttgtagtttcctgtctttgggaaagttatggaaagccagtgaaatatcacaatggcagttgtcacgtgttgtcccatctgagaccagactctagcttctttctgccatggtctaaaatggttgcagctatctgtgagcaggaagcagccatacagagcctcctgtctgcactgctttacaagaaaggagacagggtaagagtggactggcaatttcctgactcagcctggtgctcactgcacagctccaatctgccctcggaggtgatcctgcatgtgtgtaactgggcttgacttgtctcatgccatctttacaaaccacaagctctggggactgtctggggtacagggttatctggggacccttctttcccaaagaaaccaaagcttccggtttccccttctcttcatcctgcctctttctctattcaagaccttgcctacagatggttctttgtccccaagctttgatgatctgatgacctcttgctaccatactctagggcagtgcttccaacctgtggggtccaaccctttgaggaggagcatatcagctctcctgcattatcagctatttacattatgattcatgtagcaaaactacagttctaaagtaacaatgaaatgattttatggttggggtcaccacaacatgaggaactgtattaaagggtcacagcattgggaagattgataaccactgctctaggctatctcgggggctaactgtttgggacaacagctgaaaaggactcagcataggtgaatgctgctctctggagctagactaacctgtgctgtgtctctgaactaaccttggaccagacacagatgctaagtctcaacatttttttttaaatctaggagatggttttatttccagtatcaggcaggtgagatatttgggagaatggagacaattaccctaaagagtggtcctcagacttagctgtatggtgcaattgcttaagagcttaaaccccacccccatgccttggctcccgttctagaactgattctattctcatcaaattttcagaactcctccaaatgcttcccacatgcagccaagatggaaaaggtgcctggggggtcttagcacggagcagctcaaagaaccatggctctgctagttcgacaaccacaacaaggctccctgcccaccagaacttcagagctccctacagggaggactctggtcttctgggattcagaggaaggatcttctgccatcgtcctctttcccagagcttctattcccagttttccagaaacagtgacctgagaagctaaagaggaagtgttggcatctggctgtcacgtgtcagctggcatagctgagcagtaggctcaagcacacggtgactggccttcgggggggggggtctctttgcctcaatgcctgtaaaaaaaaggaaggaactgccattatttcttgcctagatatgaaggacacagtgctaaacaggactgcctcccctgtcttgctagttaccagctgttgggaagaaatggaagaaagccagcctgatgccattcacagcaataactgggagcagaggtctcagactgccaccccccactacacacacacacacactgactgggtacttccatcaatcacaccacctaaccaccctattacctgcaccctgcatctggcaggagggattcctgagcccctgagcccattcactttgtaaagggttgcaccaggatcttaccaagacctgaacttccttgcctaggggagaatttagccccaggagaaatagctcagtgcctggctggccggcaactccgttgcctatcctggctctcgagagagttacaggaactccacgccagatggttcttggtccagtgaggatgagccttgagcctggggtgtgactcaggaccaggacaagtggttcactaccagcagtagattatcctagctagaaactcactcagataagcctcagtttcttccagtttccatttctaccaagaactcaactctggatttctatgcactctggccatttaggactaggtgacctaggacagagtaaataatctctgagtgtttggcttgttgatctgtaaactgtgtcaggctattcctacctatataagtgatatgtggaaggaaggaatgtaagacactacagtggagagcttatagtaagcatagcctaagtgtttgatgttattaatcaagtagatattgcaactgcatcagctgaggtgatgtaggaagattccttgtattagtaagaagagatggattaaataatatttattacagacactattattcccaaagatccttctcccctactgccacctcctcacgttctttctcttccttcatctcatcttctctcttgttcttcaagccttcccactctcagcattctcatcccccacaagaactgcttattttccttccagacttgggggtggtggtgggagggaaacagctcgtgacttagtgcccactggtaatttccctggggttttggaagggtcttagcactgtcaggctagtacagcacttttgtttgcaagagggcagtgagaaaattactcttgggcttagggaagcaaagaataaacacgttcacagtaggactcttcggatgttcgtatttttttcttggttgttgatggtccactgcagactgatgtgataccgatgtgccttaatattaatgggtcagagctgagtaagcacggggcccagcaaaaacaaggcaagatgcttattgtcactttccccagctccgaattctgcaggaaaacatcttcgggactgcacttgaattaaaacatcccagcttcctgagtcattaatattctgcttaaacaaaaagtcgggagtgcccctctttgcctgagattggggtagtaatgcttaacccttatatgtcgatctcagccaggctgggcacctgccttccaaactggccgcaccaataaatgtgtcataaaagtcagcctttaaaaactgaggttagattcggctagttgcacgtgccctctccatcgcgcttgcctggcaaagcacacaggtcaaacgagttctactgaaaaaggcactctcagcctctgtctgtgtcgtttactccctctccccactttactgcccaggtgcttccaagcccttggcagagtcgaagtccttgccggatccagaacaccgcctccggatctgaaagccagtagggccagcgatctggctctacataccttcttaggggctcctaaaaaccgaagggagggcgcggctaagtttgtacctttaggggaaaaaaatctggcttttgccttttgcctccgtgaaaactcaactggaacccaagagcagcagcaggcagccggagtagccccaagagaagagctcagagccaggaagttggtgtcaggcggagagcatggtttgcttgtgagctccagggcgttcacagtgcgctggggacacccgacagttgcttctaaattcccgagggcaaagcggcacccaggacgccatttctttttgatgcgtttcctcctgcaagtgaagggccaacaaagcagtctcctataggcattccagtgcactgcgggtgccccatgtaaatgcttttcgtgagcgttaaacaacaactctgcttttgtgtagaaagactagcaagcaaacgcggagccatctttccggacctctctttgattctgtgttggatttgctagcgtttactctgcaacacgcctgcttgtggcccgggctgaaagccccaggcgcccatccctccgcagctcagaagaaagccattgtagggtttatcaaccccctccttaagacctcgggtttcatcctcccccccccaccatgttcggtttgttttctcaagacctaagcaatttttaatgtactctatacttcccgcttaatcctcatcgtttattgtataattatagtttcaaagtgattatgtaattaaaatcatgtttcgttgaaacaggacttcaaaagggcggcagacccccactctggcattattttctagtgatgtaataatttccctgtgatatttaaaataaacacattagttcaagaattctaaacatgtctcaaagcatatagtaggcttgattggcacgaggctggcttgtaaagaaatggtaaaacccatcactagtttaatatatttctatgctcccatgcagggtaaattacaggataatggggcgcaggcgatggtaagctctgtttatataatccatttcttcacacgagttcccattgccttccttttccctttgctgtgtgtggtggttctctgatcccctgacctcggccatgtgttttcactttttcttctgatctcaattccatgaccagcggggaataaaatacaaattgaatagtaaccattcacaggccgctcttttcaaactgttgttaaaacctctttgtcttgtctagcggttgatagataaatgcgttgtgtttctcctgactttcccccctgcctttcttcttcctttttttttttccacccctccttggccaaggaaaaaataaccctcctccaattatacgctttaaaaattaaaacccacacctcctttcaaaccatctcctgggcgtcctgctcgctcccgggtcggcccattggttcggcggcagcaggattcaccacgtggaataaaggaacgcggcagctgagcggagtgggggaaggcgaggtgcccccgtgtgccgtccctgccattgtcccctcctgaaggttcatttaaccgagaacctgtactgcctctgatctcctctcagagctcccagaatgggcccggctggctggggcggccccccctaggaattcctgaggccagggggccagggggccagggggcgagggaggggggggggataaaccccccccttagcccttcgcccttcatccgtgccccctnnnnnnnnnnnnnnnnnnnnnnnnnnnnnnnagaacgagctgttttacagcttacatccccaaagctacagaacgcctccaggtttctgacctgcccttcccagatccctgtcgcttccacctcaagggctgctgctccgggcgggtcaagccaaaaccactaatagtaactgggcgctcgctctgcagccagcccctctcttcccaagagcttccttggagggagggaggtcaagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcccggctcacatgcttcacattaaagttccgtgcccggtgccttcgtgctttttttcccttcttctcctccaaaagggttcttataaacttcccttcgtttatctagcctggttttcattgctccagttttgcatgggttgactttgtttagtttattaacccacggggttactttaactaaacatttgggctgaatactttgggattggatttcaacgttttctaacgaaattacgggggtttttgaagccgcacagagaacgctgtgttgagtttattagtcaatttaacagactataagtgggggcgggggtgcgtttagttcagttcgagttcgtacccattcgaccgaagaagttagccaagccttgggatagggttccacccgcgtacgcagggcttgtaccccagcatggcctcggggttcgccggcttcctccgttcgcagactggctcctgggcgcgccaagctccggcccatggaacctaggcaggcgacctagggcgggacccagagactagctgggcgacccagagggtccctcccgagccttccacctcctctctgacaggaggttgtgtttggtgctagctgtagagggtttggtggcttccggtgagaggccttgaaaggaaacctggctatggtggaatcttccagaaagagtggagatcaatgaataactgcctgaggtgagcttgagggacgacaggataaccaattggccagttcatctcccgccaggatattccaccaaacccactgtatgttttttccccctaaacctgaagagctgggacatcccagggattcgacacagtaggaggcatagcctcctgccgcccacctccagcttagcttgagccagaagaaaggaaggtaacccgcatagcctgagaacaaggaattttctccaccacttcctgccacacacagactcttggctttcaaggtttgagccttggtgccacctaaaatgcccgtgaactttatgcatctcagacaaaactgagagctgtcgggggccgtcaaataggaagccccagaaagtaggctgggggtgggggggagggacttcagctttctggggcaatagtaaggtgggaagatgaaaaacattgatatttcttatcttaattccggactggacacgcgagtgtcactccgtgaaaacatgtgactacaagactacacccagctacaagactaacaagattttattatttatgcaagaaggacaaatattggaaagagttaagtagagtaggaaatgattctcagcttcccccagtttttgtctggaggaaactcctgttagtttttcatgacttactctagagcagaaaagagtttgcacaaaacctaatgcctaccactttgttcggtgcctcacttccgccctctgactctgacaccccgaatgcttgctgagaaggcctcctctgctagcagcttgtttgcctcggccggccggcctgttttccttggtctggctctgccaatacctctcgagggtgatgactggagaccctcccgttgccgatgtccattgcatccatggggtagttagttatttgaaccggttagttagtagactggtttgttagctaccgagctgtttgataggtggttgcttggcgtgtaggttggttagttagttgttgttagttgttagttgttaggggttgtcactctgcagacgtatctccagtctgacttaacacttctttgggataagctctgcccacaacccgtccctgactagttcatggcagaaagccctttataatacttggggaggcagatcttcatgtttctcttctctcttccaaatccaaccccctgtctaattcccagctctgtagcagagcacctaccctcggtctccccttcctctccaacccccatctcctcccctctgacctccccaaaccttctttccctgaactcatcccattatcccagcttccaacaccagcaggcattcccagggaacatgaggctgggaaacaggtaggctaactgcaggtcctcacccctccctcctctcctccagagccagtccctgatgctgcagccccccccccacctcctctttgcctctatctccaggtgatcacccagatcttctctttcatccttcctccacactgaccctcttatctcagcccccaactccagcaggcattctctgggaaccagccagccaaccaagtcagccagagaagcaaaaagcacaatgaagcagctaagggagccccagaccatcactctctttcctcatcccagcataaaaacacaatcaataacagctagggcaatatgtctccactagagcctagcaatcataccccagtaggtcctgagtattccaacatagctgaagcacaagaaaaagacctaaaaatagcctacatgaatacaatagatacccttaaagaggaaatgaataaattcattaaagaaatttatgaaaatgcaaacagtggaaagaaattaataaaagagtttaagacttgaaagtggaaatagaatcaataaagaaaacttaagctgagggaaatctggaaatgagaaatttaggaactcggacagaaaaccctaaggcaagcctcaccaacagaatacaagatctgggagagagaatctcaggcattgaagatgaaatagaagaaaacatttaggaaatctgagacatcatgaaaagaccaaatctaagaataacaggaattagaggaaggagaagaaaccctggtcaaagacacagaaaataatttcaacaaactcatagaagaaaatttccctaccctaaagaaagatatgcctatcaaggcacaaggagcatactgaacaccaaatagactggatcagaaaagaaagtcctcttggcacataataacccaaacactaagcatacagaacaaagaaaaaatattaaaagtggcaagggaaaaagactaagtaatatataaaggcagacttattagaataacacattacttctcaatggaaactctaaaagccagaagggcctggacagatgactctaagaggccacagatgccagcccacattgctatatccagtaaaaattttaaatcacactaggtggagaaaatatggctttctataattcaattcaagtcccatacttatgggacacaatataagtggtattcagaggaaaattcttagcactaagttcctatataaaaatactggagagatcatgtactagcaacttaacagcacacctgaaatctctagaacaaaaaagaagaaattacacccaaaaggagtacaatgcaagaaaacttgggactaaaatcaataaaatagaaacacgaacaaaaacaacacaaagaatcaatgaaacagagttggttctttgagaaaatcagtaagatcgagaaacccttattcaaactcttaagaagacatagagagaatatccaaattagcaaaggtagaaatggaaagtgggatataacagcagacactgagaaaaatccagagaataataaggacatactttgaaaacccatactccacaaaattggtaaatctaaaagaaatgggtaattttctcaatacatatcacttaccaaagttaaatcaagatcatatacaatttaaatagatgtttaacccctactgaagtagaagcagtaatgaaagtctaacaacaacaaaaaacctcagggccagatgattttagcagaattctaccagattttcaaagaagagttagtaccaatactcctcaaattattgcacaaaacagaaatagaaggaatactgccctgttcatgttatgaggccacagttatcctgatacctaaatcacataaagacccaacaatgagagagaattacagaccaggttctgttatgaacatagagaaaaaactcacaataaaatatttttgaactgaatccaagaatatctcaaaaagattatcctctatgatcaagtgagcttcactccagagatacagggatggttcaacacacataaatcaataaatgcaatccaccatataaacaaagtgaaagacaaaaaccacatgattatctcattagatgtagaaaaagcctgtggcaaaatctaacactcttttgtgattcaagtcctgactggattaagtatacaagggacacacacaacataaggcagtctgcagcaagcccatactcagtatcaaattaaacagagagaaactcaaaacagttccaccaaaatcaggaacaaggcaagattgtccattctctccacacctattcaatatagtacttgaagatactcgaaggagatcaagggaatacaaattagaaaggaagaagtcagagtatctttattagcagatgatataatagtatacataagtgacctaaaattccacttgggaactcctacagcagataaacagtttcagcaaagtggctggatacaaaagcaactcccagaaatcagtagccctcctctatacagatgacaaaccaaacagactgcaaaagaaatcaggaaaacaacatctttcacgataacctctaataatataaaatatcgtggcataactctaaccaagtaagtgaaagaattgtatgataaaaaatttaaggtattgaagagagtaattgaggaagatatcagaagattgaaagatcttccatgctcatggatcggtaggattaatatagtgaaaatggtcatcctatcaaaagcaatctatagattcagtgcagtcaccatcaaaattccaactcaaattttcacagatttttgaaagaacaacttttagctcacaaaaagaaacacaaaaaaacagagacaccaaacaatggaatcaaatcaaaggcccagactcaagtccacagacagacctatggacacctgacttttgacaaaaaaaaaaaaaaaaaaaaaagctaaaaatacacactggaaaaagaaagcatctttatcaaactggatgtctgcaggtagaagaatgcaaatagatccatacttatcatcctgcacaaaactcaactccaaacggatcaaagacttctgcataaaaccagatacactgtacctgacagaagagaaactgaggaataaccatgaattcattggcacaggaaaagacattctgaacagaacaccattagcacaggcactaagatcaagaattaataaataggacctcatgaaactgagaagatttgtaaggcaaagaacactgtcaacaggacaaaatggctacctatagaatgggaaaagattttcaccaactccacatctgacagagagctaatatccaaaatataatcaagacacaaagtaactaaatattaagaaaacaaataacctaattataaatagggtacaggtacaatcagagaattcttaaaagaggaaactcaaatgactgagaaacacttaaagaaatgctcaacattcttagccatcaaggaaatgcaaatgagctttcatcttacatgtgtcagagtggctaagttcaataaaacaagtgacagctcgtgctggtgagaagataggacaaaatgaacactcatccatttctgatgggaatacaaacttgcacagccactgaggaaataagtgtggcagttcctcaggaagacaggaatcaatctacctcaagatccagctataccatccttggctatatacccaaagggtgcttcatcctaccacagagacacttgctccgccatgttcactgctgctctagtcataatatccagaaattagaaacaacctagatgactctcaacagaagaatggataaagaaaatgtggaacatttgtacagtggagtattactcagccatttaaaacataaaatcatgaaatccacaggtaaatggatgaaactaaaaagacaaaatcctcctgagtgaggtaacctagacacagaaagacaaatatgatatgtactcatttacatgtggatattagctgttaagtcaatgataaaagttaggtgaagctgcaatcaatgaaaccacagaggtcaggtacacagcaaggaccaaggggacagatatccctaggaaagggaaatggaatatctatgcatggctggtgggcagcgtgtggctggaatgggaagatcaagtggcaaagagaaggaggagggagagtgcagagggggctgggcgaggaaatacagggagaggcagctaaaattaaaggccatttgaggcgtaatatggaaatctaatactgtagaagtgtgtgtgtgtgtgtgtgtgtgtgtgtgtgtgtgtgtgtgtgtgttttaactgaaatcaccaaataatggggaagacagtgagtcccaactggacatctcttgtcaccaaatgaagcttccaataccagttacatataattgagaaccccccaaaaatctaggctgttgccaagactgtaggttgctctccacaaactgatgacaaagccccattgatgaagacagcacctatacatttattgaacacggagaagttgagctggtgactgcatagagccataacacatacatgctattgtctttgatataggaaggcactctgcaggctaccaaaagagaagtataaacaccaagccagccacaaatcctttgatctacaatggtgtcttgcctgcgagatatgctaattcagtggtgatacaaagcttgtgggagtaaccaacaaatatctgttttgacttaaggcccactccatgagatagaacccatacctgacactacttgggtgaccaagaacctgagagtagattgcctaggaacctagggtaaaaccaaatactactgttttaaaaaaataaaatgaaataaacaccaccaccaaaaaaattacagtggcaatgaaatgactcctaatggtatgctattatactcataatcagtgcctggttcaaccattgtcaaagaacctcctcctgcagcagatgggaacaaacagagagactcacagccagacattatgcagagagtgagagacatcggaacactcagccccaaacaggatgattccattaaattcctaccctcctggctcaggaaaccccaaagaagagtagaaagaaagtaagaaccacaggggatggagaactccaaggaaacaagactcaataagtcaaaagaatagagcacataccaactcgcagagaccgaggccagaaactctctctaattgatagccacctacaaatgaaaactgagtttcctccaggagagtctcactggggaaacaaactgctcttaagggtaggctgctgtccgaagtagatggccaagagaaaacaagctcagtggcatctttggagttccttgtctcaatgtcgtgtcagagattttctttttttttaaaaacttaatcatattttatatttcattttacatctatttctctctttttaccctacaagtactttgtgtacacattatggctcccggcttagtgtttttatggattctgggaagagaaaggaatttgggatgaatataggcacaagagagagacaccagtgagacaacgagcaagttggagatacagaatgggagagaggtaaaaaaccacatagcagaatgttaatttaagttttaagaactagttggaaacaagcctaagctaaaggtcaagctttcataattaatggtaagtctctgtgccattactggggagctggccatcttaaaaaggtcccacaaggaagtctaactatatctgagtgtgcgaatgtgtgggtctctgcatctgtatctgtttcttgttccttttcttgggctcttttccttctgtttgttttgtctgattccaatgttgtcccgtgcgattgtctcgcaggcaagaacaacacaggacactcggatccttctgcagtaaagctttaatgtatcttgagagagagagcataagcttacaaaagcggagaccccgagccaagaatcccgtcccctaataaaggctggcaaccgccgcctgagacgtgtcaccccatgattggctgcagctcatcggaccatatgacgccacggaagaggcagagatcaaggaatggaaagttacccagcgcctgcccgcattaactttacattcggtgcctgccggatgcaggcgccatcttgtaatggagaatgcagggacggctccctacacaatgtgctagtttttattttatcttattatattttgttttattattatcccctagaagccttctcttctttgtggcaatttatttttgttttatgtgcattggtgttttgcctgcatgtatgtttatgtgagggtgtcagttcttggagttacagagcagccatgtgagtgttgggaattgaacccagttcctcttgaagaacagccattgtacttaagcactgagccatctctccagcccagcctgtttgttttccaacaagagatagcaaggaggagcatctttatggtcatttatcccctctcagtttcccattaacacagcttcacacatccagccagtggacctgaactactgggtatcgtaagatgccacaggagcccagctactccaaatattagtgatgctgtgtggcccattccaggacattttgaggtcccagcctcctccctccagacacatatcagtgataagcacttctagagctagaactggtgtgatggtttgaatgggaatggccctcatacacttgtgtttgaatgcttggcccaggagtggcactgttaggaggtgtggccttgttgaaggaggagtgtcattgtgggggtgagctttgagctcatatgctcaagctatgccggtgtggtacatagtctcctgctgccttcggatcaagatgtagaactcttagctcctccaacaccatgtctcctgcgatgatgataatgaactaaatctctgaaactgtaagccactcctaattaaatgttttcctttataagaattgctgtggtcatggtgtctcttcacaactacagaaacccaagctaagacagctggtctgactagttttagtacttcacaatcctgctttccatagagtctacgaagtatgtccaatcccaaccactgtagggggcagttgcaaagtgttgttcttcattgaaccagtattaactgcccattgataaaagctgttcctctgattacagtgagagaggaaatgggcaaaagcccgtctctatatgccttgccatcctactcgagggactacagtagatgttcttggggctccacaagtacccaggctcaggatggagagaccccttcatctccagcaactctggtccctgggtacccattgtgtttctggaatatttagctcaatcttgcagttcatcatttcacctccaaacttggcaaattttgtgagatttcccaagtccacatgcattcagatcctcttaatgtgaaatgttcatatgatccagtctggaagtttaattgtgattataaaaggaaatctgatcagttctgtggaagagcaaaaacagacatatgctcctctctttgctccccacccatgaaaaaaaaaaaaaaacccaacaacaacaaacaccctggaaagaatctgcagttaaaataaaaagcagctggcaataggcccatcgtgtgtgatgataattagacaaatgtttcccaaggttgggatgatcttgtgaagacagcatattgggtggtgggggcttgggaagtggggtagagtgagagcctgcttacagcggggttaagtgataacacaatgtcatacaatctctaattttgtaccttttgtttattgtttttccccatgcatcctgggaaacatgtcttcagctaagagagtgaggaaaaactgaaggctttgattttcaaaaattaaagccatgactagctttgggttgatcttgagtcctgagcctggaaagcctcaccctcctccatctccaacctttcctgccccagggaaagagttaagagtcttaagttaatgcagtgtttctgccatctggggccctgacttgtttgaccctatcccaaattattgtagtcctgggtctggaatagatatacagctggtcaggacgacatggctgcctctgcttctgggtggcttgtgatcaggagagcaggcctgggggctcaagaagggaaaggaagccagcaccgtcagcaagatgcctctctttaccacttctgtcctcctccttagatattagacatttacacgttagtgtgaatatgaaggccatgtgctaaaccacccagagttgtttacattttaagtttaggctttgatttcagatgaaagaattgtatcctcattgaaagaattccgagtatgtgaacatacagaagaggctgttggtgtgaaaaagaattgagggagagatgcggaattctctgctaagctatggagaatgctgatctggtatcctaccacccaaatcaatcataggtagcatggggtggggagactatacagtaaaagcagaagaaagaaaaatggtggggaggttatttttacttaataaggggacctacctgctttgtgattctaaggaaagagactcctaggaaagagcaagtaagaagctgcttgtagcaaggtcagaaggcgtcagagtgaaaaagctggggctctgaggtgggaagtgcagacacctggctgcagcagggagaccagcctctgtgtcagattttaccacaggcctgtgtcctctgtggatgagaaagatgccggcagctctgttgagaaccagagctgggcacactcagaagctggggtgactgggaaatgtattcagtgcacaagtgcatcgtgccctggtgcaggctttggggttaattaatactttgccaggctggtctccaagtcctcatgcctctgtccctgagtagctgatatcgtgagccactgcacctgctaaatgttattctctttttaaccaaaagtttttaaaatacaaaaaccatttcctaagtgagtaaaagtacaaatgaatacagaaaattatagagatagttagagaaactcaaactctacccagaggtaagcattacaacacttgtaagaacctttgacttatgattttctccatgcatggctacctagaactcaccatttaccgggctacagaaatagaaggtacttaacatcaatgagcttgcccttccctgatggggccttcatgcctttccatgccaatgtgcacctagaatatagatttctgtttggtctctctgcctgtctccctgtctttcacttaatctttctgtctatctgtctttgttatttctttggtataaaatacatagaacagtgcacaaaccatacatgttttatataatgagttctcacaagcaaatgcaacagccacaacccatcccagcacccacaacatgccccccctcacatcttgtcactttgcaaccccagccctttccaagataagcactctctggactttctatagcctgggattggctaggcctgagtttgtactttacatcagtgcaaacctgtggtgcacactcttttgctccttctttcacttgtcatcctgcttgtgagcgtcacccatgttgtgtgtatgtaatgcctatccaccctcatggctatatggtgttcaattatgtatgacaggaacttacggcatattaaagacatgttacattcatttatgctgtgaaacatttgtggattttgtggtttttgtttttgttttgttttgtttttagagacagggtttctctgtattgctttggagcctgtcctggaactcactctgtagaccaggctggcctcgaacttacagagatctgcctgcctctgcctcccgagtgctgggattaaaagtgtgcgccaccaacacccacctaaacatttgtttaacgatgcaaagatgtgttgtattcttttaggttccatttgtttaattctgtgaagctgtgttactttgcctgcctaaaacacctgattggtctaataaacagctgaacagctaatagctaggcaggagaggggtcggcagagttgaaagaataaatagaaaaataagagaggaaggagtgaaaaaagaaggagaggaggacgccaggggccagccagccagccatggagtaagaaggaaagaaagacaaatagaatagagaaaggtaaaagcacagaggcaaaagatagacagaataatttaagctaagaaacactggctagaaacaagccaagctaaggtcaggcattcataagtaagaataagtctccatgtatttatttatgagcagggtgatgggtccccaaggagcaaagaggaaaaaaaaaaaaaaaacccaccaactacaggaactgaatttcatctaccccatctaccactgttgaccatttggaaagtttctagtttgggtctatcttgaatacagctcctgtggacaatgttggatgtggttttgtagtgaatacggatacatattcctggggtttatacagaggagtggagttgctagaccacgggatgtttactcactttcaagggacactgtcagatgtcgtatcctttgtaggggccacgtggaattcttttctattcatgcgccacattcacatattcctttaaccatattcccacagatgggtgtttgtggtgatatgttgtttatgataaaaaaataaagcttgcccggagatcagagtgcaaagctaaccacactatttagccatagattccagcctgtggtggtacacacctttaatcccagcactcaggagacagaggcagatggatctctgtgagttcaaggccaccctgagctacatgagattgaacctgtcttggagtcacatgtctttaataccagcactaaggaggtggagacaggaagagatatggttgggtagagagaccagagggtacaggaactcatagcagtctaggcagtcagtctgaggatttgtagagatagatgcagactaggcacttagtctgaggcagcagttagtctgaagcagtctgaggagggagtctaggacaggattgacccttgagtctgaggtagaagtaggagctagtagctagctgctttgcttctctggtctttcagcttcccctcttcactccaatctctgactccgggtttttattattaagacctattagcattcattcaacaggtgtttatttgctctcctcacttcctccaaaaaagagctgagtcatcaggagactgaagtctgtgcttaagtcgctcagggccttcccgaggtactgtaacttggggaatcatcacttgctggatggatcactgtgcacacggaggaaaggtcagtttttgtcatcctcagcacaagcttttatgaacaactcgaagtccaccaacagaatgctcctgtcacctcagtttcagtcctgtagtgtgtgaagccaggaggacagtctcacctgctcagctgcaaccttctctagtgtccacaccaaaccaggtgaagtaagcattaagctaaaaggctccaattactggtgaatataagcaagaaccatcctgagtttggctttttaaaaatcacatcatgcacttacagggctcatgaatccaagtgatatgaagaatgcgaactgaaaagtctcactgactttgattagattcatctttagtcccctgggctccagggccccggacttccctggcattgcattctttgctattctttaatccaacaattaaatttaattccaaaatttttcttagatttattttatgtgtgtgtgtgttttgcctgcttgtctagtttcagatggtggtgagctgtcatgtgggtgctggtaactgaatctgggtcctccgcaagactaacagtgctcagcttttaactgctgagccacctctccagccccccacatgcccttttaatcaaaaggaggcacagaacccacgctgctctgtcttcttttgtcttatctctttgaccaggagccctcttcccatcaggacacagggagcaccgagtgccatgtggtcccattagtgagggtctgggctatcccatggctatttgatcacatccttgctgtcctttagtcccactttctgtttgtttgtttttcagcccagttgtactggcagcagcagaaactgccaactttcctcaaaggaaggaaaatagataatttagctactttctctcattttcatctagaaaaaatgcttttgtgggagagtgcttttcaattccagctgtccagtggtcataaaaaggaagtcagcaactgtttttggcttcataagccacactacagtagtcttcaaacagcttgctcccttagctggaggccagaagtctctactggaggccaaaggtctttgcatgttgtttccactggacctctcttagtgtagacacaagcaccaagctcccaggagtcagtgtggtcagaggctgagggtgtttctttctctgagagcctatgaggtgtacagctaccccatcacatcctgaggactggataaggagaacacagactggaagctaaaaataaaacccagaagacagtagcaggagaattcatcttcagcactcatgaaagattttcaaaagtggtgatgttgaaactgggttatggaaagatttggcaaaagaaggttccagaaagaagttagagattgggtggtgtcttacagagggtttctgttgcttcaatgaaacaccatgaccaaaaagcaagttggggaggaaagggtttatttggcttacacttcagcattactgaaggacgtcaggacagtaactcaaacaggacaggaggcaggagctgatgcagaggccatggaagggagttgcttactggcttgcttcccccgatccacgcagccatcttcttatagaacccaggaccagcagcccaggaatggcaccaccaaccatgggctgggtcctcccccactgatctggatctcacagaaaggcatttcttcaaaggaggctccttcttctctgatgactgtagcttgtgtcaagttgacacacaaaactagccagtataggtggagttagtattcaggcatctgtattggcctgtccttggagttcttacaggatacaccctcagctgcagccactaacagcacctgtgcagattcactgtgttcccttttaaaagagccctgcctacctcccatctttctcgttctctctccctccctctgttagtctgttcctttctttccctctctctgcttctctgtctatctctctgtctccctccccctctctctgcctctctcttctcttctgctattcctgtccccagagacctgtctcccctctcccgtcctccattttcccattcactttcccccaataaaaacccttccacccaagctcgcatggtgtcttactctctcacaccactttttaaattacaacaggtggtatgtccccaagccaactaaaggtgattgaaggtggctgatatgtctggagcagtgatgcatgatagatagatagatagatagatagatagatagatagatagatagatagacggacagaaaatagacagacacacacacagagagacaccagagagtgtgtgtcttactctgtacccctgactgaccaggaactctcttatgtagactaggctagcctcaaactcatagacacccacctaccgctgcctcctgagtgttgcatttaaaggcatgcaccaccaggcctaggtgttcaaaaaatcttggccagaattcagcacaaattcagtaaagacacagccattgtgggcctcactgcagagctcatcaccaagaaagtaacctggggaacacttaggattcctgagaggcagatgtatgggagtggaatctgcagatacagaaaggaagactgtgctgtgcagccttcgaagctgattcaagcaaactaggattcctttcaccatattttcctcctcacacaagcagtccattatattaactgggcacaaggactgtgtcttctgactacatttcactcagcaattattttattgagcattgagtcgagttccatgtaagcaaaacaggcataagactcagtcatgggaaattagcaagctgtatcgtgaaacttacagttccgtttatcccttattccacgtttttaaaatggcactggcttttggtcagctccctcataacaagatgaggaagttccaggaaaccactttcttacacctgtattcttataactgtcaaaaagtttaaacaaagcttttggggaccgctggcctgaatcatctcagtccttacctgctctgtgcccatatggctgtgacctttgcttttctcctctgaaaattagatatgacgatccctcatcaatgtgctgtgggcacaattggtagcatatacggagtgacgagtctagtatacacaaaggcttaatgaatagccccgctgtgtgctctgtgggtacaataaaaatgtgtcaagtctggtttctgcttcacttgggttcagtatctactcgggaggccagagtcaaacgtaagaactaattatggagcggggcctgccagtgtataattaagcggtctggtgaattgtagagggctaactataaatgcaatcggatgtcagcgatggaaaaggtggatttgggatagtggaggattggacttgtgcctggccttgcaggagaagctcaaggtgggttaggagggctcttagactaaggaaaggagtgaggcagtgagggcctggcttgtctcacgggtggagtggcctgaatgagagagagggaaccaggtcatggtggagcatggggagccagcgggtacacagcacgataaaacctggttaggccaatcttggcccagaaaagaggagaaggctctcctcattgagcagtagtctttgctctgaagaaggatggctggtgggtaggcaatggctgctcttaattagggttgatataggagccctaaagaccttatgttgagagcagtgtaactttcactaggggatacattacctagtttacaaaaaacactcgaggcagtttgtctttttcaagtcaatctaaaggtattccttgcaagtttcaccatggaagagggtgtgtacagtatttgtgcacatttggaacaagatgttccaagacatttggcagaggcatggagaacatccctactgctatggtgccatctttctggtctctctagggtggaaactctcaggacactgctgcctcactgcaggaccaacctcagggatgtctggtttctgcatccctgctttgtgtaggaagaagtgcccatcacaacggtatttaacaacctgtggtctagcatgtccaatacaaagaagaatccttttgatcctaattaaggctagggcccaaagggttcaaaatatactatatattttaggctttcttcaaagcctaaaaaaggtgtggcgggggccacaaattaacgattggttgatcattcccaagggatgatgttatcatcacagctggaaatctgagtgggaaaccgaaatattcaataatctaattatgctatcagtgttgaaaaatcatgttcctagcttatagatttaaaaacaaaagcagacaaccatcagataatctgcctgcctggggctgaggagagattaggcaaatcagaacctctgcttcagttatgcatcacacttggtggctgcaagcagagcagccattggtgagatgacaaaatcaatctactcaagcaacttctattaaaattacttacatttaagaatactttaaatttattccttgatagttctatacatgtaacatggtatcctggtcaaaattatcctaaattcctcctctcactcctcccttcctccttgaacatccaagttctctctgtctctgtctctgtctctctctctctctgtctctctctatttctctctctctgtctctcgttaaataactcactggatacaattctttcatgctcatgggtgtgggaccatcctccaggggacccccccaatagaacagtgactccatcttccccagcagccatcaactgccagtagaccctcagctggagcagaaggtcttgagtcccttctcatctgggtggagtattgactggcttgatatttttcaggtcttatgctgacagccgtagctatgtattcatgagtgtaatggctatgccatgtctggaagacagcatttcagagttgtcctctccattctcctattcttgctttctgacccccttttcaaactgttccctgaatatttgcaggggttgagatgttataatggtttcatttaggctgcatacaccaccattacttattcgaggcacttcaaccatctatgagtttaaactttgacagctgctcactacacaaagaagggtctctgatgaaggtcgacagtagcgctaatctatgtatataaatataaatatttagaaggcagtttgactacatgtccatttagcaaaacaagaatactaggttccattctagcatctataaccaggcatgaattccttcttgtggagttggcctcaaattcatgagaaagcagttggttacggccttactgttgtgtccctattgctctaggaggagcacttgcccgacaggtcaatttgatagcattcaagttccaccactatgtaagccagttgatgacttttctttcccatcagcctacatggcatctctgtgatgatgaaagttagtcatcgggaagaagtttctaggtcagttctagtttgatttcttgtgtcctgaaaccaaactgctgtgtcttcagcaatagggtcttaccaaccagctatggtaggcaaccaggagtagtggccacagttcatgctgtttggggacctcccgagatttccctgatctatatgtttttcacatatagcttttattattttgagatatgctcctttttttctgggttgcttcagggcttttaacaggaagagatgttagattttgtcaaaagccttttcttcgtcaattgagatgataatgtaatttctgccattgaatccatctatgtcatctaaaacatttattgattgatgtatattgaaccatctctgactctcttgatcatggtgaatgatcattttgatcaagatgttcttgaattaaatttgcaagtattctgttgagaatttttctatgttcatcaatttaactggtctgaaattcttcctttcttcctcctgtactccctctctccttcctctcttcctctttccttttctccctccctctcccttccttccttccttcctttattttttcctccctttcctcctcattttttttttttttggtcgctgctgttacacctttacatgtttttggtaacagggtaattatgagaagagtctgatgggattccttccttttctattctaagggctaatttgagaagcattggtagtaattctttgaaggtctagtagaagtcacatgtgatgtcacctgggcctggacttgttttagttgggagagttgttattgtttctcaagacagggcttctctgtgtaactgtggcagtcctggaactcactctgtagaccaggctggcctcaaactcacagagatctgcctgcctctgactccccaagagctaggattaaaggtgtgtgccaccaatgcccaattaattgggagaattttagttactgtttcaatctcacagcttgttataaaaatgtttaaattgtcttgttatttaatatggcacatctagaaattcatcttttttttagatttttctaatttagtggaatatttgtttttaaggtaaggcctaatgattttctgaatttcactagtgtctattgtagtggttccattttcatttcgaatgttagtaatttggatgttagctctcttccagttagtttgcctaagggtttgctgatcttgtgtatctttccaaagaaccaactctttgtttcctttattctttgtgttagttttgtttgcctgcttacttgcttgtttccgtttcattaatttctgccttgaccttaacggtttcttcccatttactgacttgaggtttggcatattcttctttttccaaggctctaaagtatgtcattaagttatttattttcaatttctctgacttcctaatgttgccacgggaagctgtaacttccttcttaggactgtgttttagtggattccataggtttggtatgttgtattttcatttgactctataaatttttaaactttccttttgatttctttaaggccccaattattatttaatagcgtattgctgtgcctccattactttgtgtatgttctagggtttctcttgctgttgttccattgtgatcaggtagaatgcaaggaattatttctattttccagtgtttgttaaaactttctttgcgatgtattttagagaaagttctttgagttgttgagaagaatatgtttttggcagtgtttggatgagatgtcctatagatgtttgttaagtacatttaatctaggatgtcatttaattcaggtatttttctgtttatttatttattttgttgggaagatctgtcaattggtgagagttgggtattgatgtcacctattactatagtgctgggtttcacctgtgacttcacatctcatagtattagttttataaagttgattgttactttttgagagggtatatgtttagcatcataatgtcttcttgacatatctcatcttctttgacttttcccactatctttggttcgaatctattttgttggatattagaacagtggtgcttttctcatagattcatttgcttggaatatatgtttctgtccttcttccctaaggtagtgtctttgtgtgtgtgtgtgtgtgtgtgtgtgtgtgtgtgtgtgtggggtgaggtacatttattggaggtaacaaatagacagttcttgatttttgtccagcctactagtctgtgtcctttgcttgggggaattaagaccactaacatttaacatttggggttattatttaaagttatatatttattcctgccattttgttgcatttgtatttttcttctttctctcttgcttaagtattattgtagtgtgccttattcttcttatggcctcatgatggattcatttttcctgggagtctgaaaggttcctttaggtgtcttctgtagaaccaacttagtggtcataaattcctcagtctatttttatcatgggatgtttctcgttttccttcaatagtgacagatacttgctagatggagtagtctggattgtcagttgtctttcatatttttctaagccctcttggcttttaaagtttcagttgagaaagctgctgttgctctgttaggctttcctttatatatgactcttgccacattcaacatatttcctttgttctgtatatttagtgttttaatcataatatgactaagggagattctcttccagtcttgtatgttctgggttctaaatatctcctgtgtttggattggtatctcttttcccaactctggggaaatttgttatagttcttttaaaatgtcttttatacctttagaacactattcttctccttcatccatgcctacaacttgcagatcatgtcttttctgaatgaaatatatatgttgaaatccccactggtaccttcttattattttatctttgtgtctgattgctccagtttagccaccttgtctttgagatcagatattttatcttctccttcattcagtcattctattccacaacactttttttatcagcttgcaatgtttatttttatttccagaatttcagatttttctccaatatttttaatctttttaaaattcccctttagtatatttcattgtctccctgttttattcttttgttttcctgtgttctcaatcaggcgctcacctcttcattcatctctttgaacatgcttaaatttattcttttgaattctctgtctgggattacatctaattcactcttgctagatttcattactatatgattagtaatttgagaagagggatatgttgtgtttttttttttcatgtttcttatgttactgtgttgagatttgagcatttgggatcatttcattgcttgggattttatcagctgtattcttccccttgacacatttgtacgcttaaatgatacttgagtgtggtagaattgaagtacataattcagaaaatagtcccccagtctcaggttgcctgggtggtccctgtatcatctcagagtagaatattaaccgtgagaacagccacagctgctagatattacagctatgcaaatgtcatacttgccagttagcaaaagtggcccctttgacttcaattgctgttagagtttaaacaatcaaagatagtatggagtatactgggattttagttgttaagattaggattggaagggaagtaggatgggtgaagatagggaaaggattgaattaaatttgaaaaaaagttaaggtgggtaaagcagtggatctctgtagctcccatgtccttcgtggttttggaatatgtggaaggggaggctgtaagtcctttcctagtagttccctggaactctgcaccgcctgcaccctggcatcctctgcttctgcagatccagtgtttctactgctcttccctggtggcttagttagagaggacttgcccctggcctgagtctccgctcccctgcttgcttccctgcagagatctcccctgcttgatcccctgcagagatctcccctgcaatcaatcacaagttcatttacaggcctttcctcttgcagaataagtgtttactgtgtgctcttaattttgctgtcttttaaatgtatttttatccatttgttattatgtgagtgtgtgctattttcctcagggtttcagtggtaaaggcttctaatcctccaatttccccagaagcctctaaaactattattttttaatttttaaatttgtgacaaaatacatagaaaatcttattatccaaaccatcttgttactgttttgctggcatggggggggtactgctgtgtacatgtggtggtcggacgacaactatgaatatcattcctaattgtgtgtgtgcatatacaacacatcataacaaggaatcgagtcatgcgattctggaggctagagatcctgtcacctgccatctggaaactggaggtgtagccaaggggccaagtccaaaagtttaggaaggcctccaaaccagaaggcctgatgtccaaggtttggagaagatggacctcccagattaagcagagagctcatctgtcctttctcggtttttgttttgttcaagctaacaacagtgggagttgcctgcctcactggtgagcactgagtttcattgctccaattccagtactaatctcttccagaaacacccacttgaccaaccatctaggcatcccacaggtggactcaaaattaagtatcccatatgcttgcataaggtgcacccacggttctgagcatcccatatgcttgtgcatggtacacacgcagttctgtacttgcctgtgtgcttatctcgtcctctgtagatggatgttcctgctgcttgtaatcttttaagctaacattctgtgttcaaattgaacattacacagtatcatttcccacaggtgagccagaactcttcaagagtgtggctgtgattctgacaacctctctcggttgtgtgcatagccgatgcttatgggatattcttcaagttcttcactcaacaccacaaccactctaccaagtataatccacctgttccatggagaagagtctagagaagcaaactggcttgttccagatgccatggtcatctgctgtaggggtctgtgcctacagctccattgaccttccaattgcagtccttgctcaagatgtatcgtctgtatgaagtccccgccttctgagacagataaatgacactgtgtcacagtgtcctagagtggggacagggtgggacttgaaacaaaacttcaaatactcccttctgtctggacaaccattccctgtccctctcaccctgtgtcacaccccacacacccccacacacccttgaagattctgtgacctctggatgccctgggaccaagccttccttgctgttcccacagcaaccattctcaacacacagacttacacatgaggttccttgtctgtcactgagattattcttgagggcattatttgcttttgtttgacactcacctctgtagcccagcccctcagtggaaataggctgcttctgaagtttgagctggactcaaatctttcacctaatgcaacaacaggacaagagcttggaatctggggcaggggatggggagggtagggagggtggcggaatgacttttgctgaaggcttaggaggggatgcctgaggccctttttagatgccccatagagacttgacagactgcccagccttgaggtcttccccacctctcccatgaagcccattccactgatttcatctgttaatgtgctgtcccccaccactcttgtgtgtgtgtgtgtgtgtgtgtgtgtgtgtgtgtgtgtgtgtgtgtgttgtatgtgcatgtgtctgtgagggtgttgaggtgagaggagggtgttgggtacactgctacttcattcttcactttattcccttgagacagggtctctcattgaccctggaactaggatggtaccatcaaaccccagcaaccctccagtctccacttcccacaacactgaggtttcagggagacacactttgcctggctttttacaaggatgccagggatttgaacacaggtcttcaaacttacagagaaagcactcttgccactgaacaatctcccaggcaccttgttctactgacttcttgttttcttcagtcccactatacatgccttccacacacttgtctgtggccttgccctttctggagatgacccttaatgcatgtcttaatcataacagctagcccccagacagcacagtctatgtggccaacacttacaaatctggatgtgcattcagacagtcatggtgactgcatggaaggttctgttacgatattgcctctgccgcagaagggatggaggcacactaaggtttagtatactgtataaaagtcacagtcaagctgtagggcccagattcacagccacaaagtctagtttcagaatccatgcctttaaccattacaaggcaaaattcctcaagggtcacttttctcagtcactcccacagagtcaacccatggaacccagcaaaggtgtcaagaatctcagaaatcccttaaaggatagcacctagtctagacttacctggcaatctcacaatttcttttggagccacatggcttcaaagacctactagttcttcttgtcatctggatttggctgctgtggccaaggctgcctttttgtgcagaccacatcttagaactttcttcattgtttgtcccttctgatctgctccataacaaaggaagcaagcagcaagctctttccccacttgtgagcatccttgtgatttcatgcatgcattcatgtgtccatctctggagatacggcagaagctatggttgctggagtttggctaaccttaaactaagcctttccagggtagctctcagtctagactgcggatgccagtagaggagcaggataaggctgagggacttcaattggaagtcccttgaagggcagcacactgaggactgtgctattcttcttaggtagggtgggggaaggggctatggtcctcacaaatcaagcaggatttacacacacacacaaaaatccctgctctttcattcactgacagttcctaggacagaggaaacagggagcaaggcagaaagaactggaccccatgggacacatgaattaagccttgggtagcaggaatttctgagcatccctttcccagggtgcatcacagaagagccttcctccacaggtggcctataagggattgctttgtattacccaggatgctcctgttgggggtgccttagctgtcatctgcaagtgggttctaatgttctgtcacgaaggcaaactgaccctcaacagcacgttgaagacacaaatgttctcactgagctgctggctgctgggctactcaccctcatgcccacccccaccccactgaaatagaatccagtgatttaaccaggctgggaggaaagccggctgcttccagttagttccctgcatgtgccccctgttgggggccagctggtgagacaccggtgtgggctgaggttttcatgtggatttgggaaggttcccactgatctgaatgtcatggctgctctggtatttaaagttgaaattccttgattcgggtcaactattttgtgcagagcaaacctgatgacagtccatggggaatggctaagaaggaacactaaagagacatgacagatcttcaaacaaagcgaccggagtttgcctagtggctgtggtcatctgcagggttagcttagacacttttcttgcttggaaatttccctttggaaatccagaacacgctggatcttcttgcaagcctgaggaataagcaagggtttatattgctgaaggtggatttgatttggggattttgtcacaaataattcatagccaaatctggtgatccccctccaggaaccaagtctgctgacgccatttgggacttaaaccaaaaagcacaattatcaagtaatgcatctaattttcatcctgtgccagttggggagctccagaaagaaaaatagagataattcagacgagtgacacttcccaacattttcaaaccaatttcgaaggaccagaattttttaaaccagcctttctacttgaaaaccatacacatttgtgttaaaaattccttcccctcttaaataacctgtgagtttgtgggggtttaagcttattaaccggcactgttttcttgtattaatcataggccattaatttatttcaatagtcctaccactgcgcctgtgtttttcctggctgcagtccagttcctgaatgtactgccgagcaaggagcaggcagtttatcataacacagagctgagattattgttgagaaaagcgcagggggtagggggttggggtctacaagtgcactgctggccaggactggaattcactctgggctttcttgctctccagcaatgtcttgctaaggaggtctcctgtcatgaggtcattccattgtgattggctgagcactaacccttgcctggcattagacttagcatttgaggggggttaaagaggagactatagctgccatacaaccaattaaacatgatattcaacctacaactgaagttaattatgagtgaggcccaatacaaacttctaaaacctacctgaaatattatcagattttttttgctatttactgattgtttttgatcaaatggttcttaggtgtgaactctgtaagtaacactgtggtggtgtagccttgggactttaatatgttgggcatacccatgagagacggagaagcaagcaccacgaatgaggcaaacaggctgctgtcaggtcatagcatagacaaagccagaggttaaaaactcccaatgagtggtgtttgagagacagctcacagagaatgtgttgggagggtggctgcagtcctcttcagctgtccttgaaccccttttcttactgatgagttcccaaccaggcccccagagctgggtgggttctgagtatggggttacagcattaggtgagacattaatcacaaacatgaatcagcctgttctgtccttctgccaagctgttacctgcatctagagattgcaggggaatttattatgttacacaggaagagaatcccttctgtgtggcaggcaggaagagaaccgatcttaggggctaggtgacctctttggttccacaaggactgtgaccaccaggaagggtcttttctcaggtagtccaacccccaccccagccctgtgactcctcctggaccctttcactcctcctgggcccaattatgtgtaggtcagaaactggcttgggctaatatttctgttcatattggttttctgtcagtccaggatggttagcttatacagaaaacacacttcacatccaaaccagcaggtctgggtcaggacctatggttcttccaaatgctcttccttccacagccatctcggccaggtggtgttccttcagtctaaccacatgggctctggaccctccactcaccgcctaattattgcagagtaactatcacttttaaatactcactatggtgtctgtctctactgtttgagggagcactgttggcctgttttcatattttgtcaacactgtccctgtgtcttgacactgatgggactgcacaaccttctaagggaaactatggctcagccacaccatcatgaactatttccttccctttagtacccttagtaaagaagaggccccaggattctcagagggtgggcagcttccccaacacctttgtaaatgtaagtgtggatcaggtaccacaatctgtgttctccctccctccctcccttcctctgtctgtcccttcctttctcccttccttcctcctgctccttcttttcctccttccctttctttcttttttttttttacttaaaaaatgttattgcactaaagttattacaatgcaactgattcctcaggaaactttagtgcctcagacttcataggtcaatcccaatagtgctctagaaattctatttaactctgcgtttgaatgtcacatctatgtagcaaagggagcctggttgttgttggtttttgttttttgggttttttccttctaccttaagaaagtttcatctggaaaacaggcactagagagtgctagaaccaacaggtttttgttttgttttgttttataatcaaaaccaaaagcaaggcaggcccatatcattcatgcaaccaaaagtaaacttggacagttaatctagaagggagaatttcccacaggggcagaatggtccagtatccagtgagcaagagaaagataaaaatacaaagggaaaggcatcaaatgttcaaggagcttttgtccactcctagcaagcccatctggacagcaaagggtccaggagacatgtgtgaacagacacggatgcatgcctgtcaacatgtgtgaacagacataatgcatgcctgtttcacttggaggcacatacatcagggattatgcacataaatacccctcaaagtcaaagtcacttggtagctacaaaggctgggtgtacattagacaaaagcaaatggaaacagaaaaaaaaaaaaacacagatatacacatgctcacctgatgggggacatcctcaataagataagtttataaagtatgtagattaatgattatggttgacacttaagacagagatagcagataagaaatcctagtcattggccagcagcattgtaattaataagagactctgtgtgttatttcgggggcccacatggcgatggggcttgggcggtttggcggaaagatttatcgttgcactcacctgcaatgtgggtatacaagcatgctgtccaatgcatgtcagcaggccaccaccctgtcctggatggagcctatcaacatgattgctcctcagacctctgtttttgcttttagtgtgattaaaaacattggcagacaaggctggccaggattgttgggatgatagggttggcatcctccaaagagaggagagcaagtggtacccaagaaagcctaagtagggtatttagaaggcaggggtgagctgctagggttggggatgctaggcataagcactgatgatgtgatgaacatctgtacctcaaagtacttggggcctcaggagtcaaatcccccggccaactccatgcggttggcagtcttggatgctgtcacccttgcctcaagctaagcatgctgtctgcagaacaccctgtggtgatggtctgtggtccatcatggggaggtcttgctgggctgtactgtctctcctctggaggctgaggcagcaggtgtactagttcaaggtctgtctgctacagagtgagttcaagggctgctttggaggggggcctatagcttagtggtagagtgcttgtctggtttgtgggaggccctagatccaaatacacacacacacacacacacacacacacacacacacacacacacacagagagagagagagagagagagagagagagagagagagaaggagacacacacacacacacacacacacacacacactcacacacggtaatcatagcattcaggatgctgagggaaggagattgtgaatgtgaggctacactgggttacacagtgagttccaggtcagctttagctactacaaaccaagacatgggagtaagggaggaaggaaaggagggaagcaaacaaactacaaaattgaagccatgctagcctctttaaaaaccctgtggcagggagtccaggttaccagagcagagcacatgtcagatgcaggattctaggctatacaatggctgatgggtgtcatgctaccacacctatttcccagacaaatgaaaagcacaaaactgcatcacatttcctgctatgattccagggaaagaattgatttggtacctgtcccagtcagggttatatgactgtgatgaaacaacatgcccaaaagaaacttggggaggaaaggttattcggcttcccctccacataactattcatcaccaaaggaagtcagggcaggaactcacacagggcaggatcctggaggaggagctgatgcacaggccataccctacaggtgtgtctgcttatagctgggtcttctgtgggcactttcccaaatgaggttctttcctttcagatgactatagcttgtgtcaagatgtgtggtgatgtattagttatgatttattaaagcttgtctgaggattcagaaagcaaagtcagtcacaagccatagaagacaggcacacatctttaatctcagcagccagaagctaggaggtggtggatttaggattaagagatagactgggatcacgtacctttaatcctagggaggtatagaaggcaggagcaaggtctcggtgtcagacattcattccccagccacgttgaggataggaagacattgaagtctgaggattctccagccctgctgaggagaggcagcagtctgaggtttggtggagccaggatctcaattcagtctgaggtagagtgagagacagtgaccagctgcttttcttttcttttcttttgcttgaagtgtgaacctaaatatcagtctctgggtcttttatttttttgtacaacaaagatgacataaaattagcccaacatggaacttgtgaaggatgggttacaaatgctaatgaatacttctcttcaagagacggacatcattttttataagacttcaatctgttttccaaatcttttccacttatattccaagggtgccatctagctctttggacacaacccctaacctaacaggcctcagttaaaggcttgtgatatatagagagcacctatgtgggttggtggcatgctgagccaacatgtcttagactcatgtttgaggacacacaggaggagaataaaaaggcatgctacatacgtagtgtctgctggcagcattatccactgactctccactccacacaagggacagaggcctttctagacaaatgccgattctctcccaagggagaggactatcgctcaggaactaaacagaccctcaggatggaaaactcttgcagaatgtccaccaaagggcctgcgacccagaagacacggtgctttgttagccacacaggacataagccaagcagcatgtagcttcctcacatgtaaaatgtacagtatgatcgatccagtgagaatgatttccctgtcggaggagactctgagtgattaaacacaaaagagaacaatctagtatatccgttcggagaggctgatgatcctggagagaaagggagatagatttgtgaagtagcaggaagctgcaatccaaatgcagagcgaatgagttaattacacctggagaggtgacctctccctgtagcccgggctagagctttggtgtcgaaagtcaaggagtcagagctgccaccttcatgtctccagttctatgtgcagccaagagctgtctgcattacccaagtgttgtgcaggattagaggtaggcaagggcagccagcaatggcgaaacgtcaggtctctgagtggagcaggctgtgagatttttccacccattttttctaaactttttactttggagtttttaatctgggaagcaagagaccatcctggggtgacttcttcaagtacctggagaagacaggtatttcagattctggggatattggacatgaattgttcctagtctatgaacgtgtctatagacataaatggggtcattccagcctagacctggacatagtgcctggggcttagctggggaaaatgccagtggagggagggggctgatgtgtaacttgtctatgttctcccttgaatgtcctcccacagcagctggaggtctgtgcccttcctctacccatagaaaagcagaacggtgtccccgtcatttcaaatgaaagttctttgcttttctgatgcttcatctatagcctttcacaccacacctgacatagatcagtcacacactgaagcttgctgaatgagataggacaagaaagatctgtaaagatggaaaacaactcagaaatgatgaaaattcatggggacagtttctactgcctctctcagcccctgctgttgaaaggacagtttatcatgtgaatcaatgatttttttttaaattaagatttagttttgtttatgggtgtgtgtgaatgcttgtgagggtgctctgggaggccaaaagagggggttgtagccctcgaagctgaagttacaggtggtttcaagctccctgaagtaagaaccgttgtcaccaaacttatgacactgctccctttctccagccctctttatcagggattctaagtccttaactatactatccacgagcgttaccatctcacttacagatcctttttgcatctccccttacacatctgttctctgcctcctcccaccttccagtgctaggatcagacagcacacccagccttgtgaactgctgttttctcttcagaacattccatatttctgtcgccagtgtcaatagataccatctgtgtttaaacctacatgacagtaaatgccatgagtagacccaagattaccacccagttgggcatgggagactctgggcagatcttcatttaaggggcagaaggaagagggatccatgagaaactagaaggtggccagaaagataagagaaaggtatgaagcaagaatggcacagagggaagagagagggagaaaaggctgcatcgggaggcagaagtctctggctcataggtgggtttcctaggtggaatgtgactcagcaggaggggcccacagtgtgctttcccactgtctcctcccactaggaaataaagagatttagtcaggtgatgacctttgtattttgaaagagtattagttagggctgcatttggctacatttgagggaatcctaaacagtaaatcacaaccaaaaatattttatttattatttttgctttcagggtcttttgtggcccaagctagctttgaacttactatatagtgaacacctgactcttctgcctccatcaccaaaggcccacaccacccagctcagccaccaagaggatcttttttcttttctttctttcttccattcattctttctttctttctttcttttttatttttagttttttgctcagttgagaagaaatttcaaggcaggtaaaggttatgataactggtcaagggacagaggggcacaaatcccattgagtgcttatttaccatgatcagtaagaatgtcctccttagttttcattttgtttgagacagggtctctctattatacagctttgggtgtcctagaacttgctatgtagaccaccctggcctctaactccacagctatccatctacctctgccttctgaatactgggattaaagacatgcaccactattactggcctcctcaggcatttaaggtaattattcttcctctaaccatcatgcccacactccaagaaaaagatgggcaaaaggatgaacaaatctcctatattacctgagtctatttgcatggaagcctcactccacaaactctaacatgtcattgctcagaactccatggtgtagtttctccttagggtagaagagtctggaaatgggcacagatcatttcttctgtcaaggaaaatactgggactagatactagtaagcaacaagcaacatcctcgtataggctgaccatttgagaaaagtttggcttgaccattaatagcaggtaaccttcatagattgatgatatttcctagtaaaaaacaaagatattaaagtaatccatttgatcctaatgcaagtaggaagtaaaggataaatcatacccactcctgggccagttttcctcacaaagcaggctagttccaggtattggtgtcagctgaccctctgagttccagctctttccattcccagacagccctctcatgctttttttttatattactatgaaattccaccttgcaaaactagttggaaaaatccaagctcagcaaattgccgagagactaggccatatcaggggagccacttggagccgggggactccctgatgacagacatgcttgaatctgtttaatctccacacttgcaaagtgctggcaactttagctctgggtgacagagagggaagccccatcacaagtacagtatgggtctccaggctggccatggtgcaggaaaaggctactggctagttctgagattaaaaaaaaaaaaaaaaaaaaaaaaagaatctgaggtagggaaaggtttccctcatcagaggtcatttggttactgtagttccattttctcccagtagcctctgttcttgacaggttgactcccaggctgctgctcttcaaatagtgcgctacccagagcagggcagtatctttgaggtgtagcctaagctttaattattttttttgcttgagacaggatcatatgatgtatcccaggatgacttggaactattgagtcccctgcctcagtttcgccaggactgggattataagtatgtagcacccagtgtagcctgccccatataaagtcatttacagatgccccaatagatggtgtctcctccagccacatcttgtctctgccctgttgccctacccaccaatcccccacatctccagaatcatccttttgtcagctctacacatgccagaagcgactgctttctgggaacaggcccgatgaaagaaaagttaggcaaagctgcacaagtgtgccaagccctggcttcagaaaggagagttggttatttccaaggaccagtgatggaaacacaccaagatgaggcccagtggcttccgactcttcaccattgcccagtactctctgcccagcacccttccactgaccatgggagatagctctggggaaattccagtctataatttgttgaagcaggataaacagagttcctgctccatgggattctaacatgaacaagaggctcttggaatctccttaggagtcttgatatccacgtaagccataaacatcagaattaggatatgtgtgacgtaacagattctgaccctcaaggccacaggacaggagtgagccatgacaatatactctcgtcttggactttcatctataaagtgactttgaacagctctgagaagcttcaaagattttgtagagttgccacaaagatttgatgtaaatttccttgtcttaaaaaaaaatgcataaggaagctgggtgttggtggctcacgcttttaatcccagcactcaggaggcagaggcaggcggatctctgcgagtttgaggctagcctggtctccagagcgagtgccaggataggctccaaagctacacagagaaaccctgtctcaaaaaaacaaaaaaaaaatgcaaaaggaaatcaaatataccatatgccacattttgaccactaaagactgccggtatgttcattatcatgccatgtaaacagggcatgcagacctcataacaaaaaggtctttcagtctgcttaagagaaaagcaccaagattgcaaggaaagctatcttaacaacaacaaaaacccatcttaccacatgcaactcattacccaaatgaggattttttttttcttaacattgcacaaccaatgattccagaaatatattggacacagaggcaaatctgactgcccgtatccatctcttcactttggaaggttattaaaaatgccttagcagagtcattgattagcctccatttgaacttcaccataacttcaaagggtattgataccaataaactgctccttatctaattgggtttgtgtcctccaaatgtggtttatattactcagatgtttgaaaggcatcagtgcagaagctacaaaggggcctcagctgtgattcagcttcctgggtgagcgctgaatcaccacgacaggaattcccacaggtgcactgcagggctgcagtgagcacaggaggtgtgatgcggaggagatggtcaaagttacacacacatctagtgcccagtcagtcagtatccattaactggaagagccaagcattaggaggtaacagatctgttctagatttgcaggaaagccagaggcccatgaaagaataagggcaaagaagccaccacagcagcagttgatgagtagagcaggccagttgtagcaaagtgttgatgagaaagtcaggtattgtgcaagaaatgaacagatccttagcaaattgcaagagaaaaccctcagctgataaaactcagcattggggacctctgagtaccagcctcaggattcaggcaagaccctaaacagcatgtgcgcgggctgattaaagggatctgagagtgaacgaatcagctcatacgtgtattcttctcatgtctccttattcttcaaatgttctctttcgtcccacaaggtttccagcttatatacccatacagacacaactatcaattctctggcaatagtaaggataccggacatacatttttcagggccaagaagacaaagaataataaagtgggtacctgttatcttgctaatgtcttagagggggcatggctgtgaagtacccagacatatctgagaacgttcaatagagtaaaaggctacatagtatagaatccaggacctggcatttccagcctctggaccaagcagtggctttgttcctgctgatccccagtaagaagaatttcctttccctggagccttttcaagaatacaaggcacccagtatatattctatatatcaagattatacccagatatatgtgcctagtatattgggaatgtatttatgagacacatacacatatatacaggctagggagagaatgcaattagcatatttaaaattacaggcagaagtgacagatattctggagtctgtatttcttgcagactttgcaaggcgagtttcctctaccagaagttaattctggtgggttgacacctagaatattaattgctacttctggaataagcgataaaggatctcagcaactcagaccttaattcatgcttcaacacttgttctgtttaggcccagagacagggcattggaccctggtgctagggtgcttgcttaccacaaaaaaacatgttctcgggggcacaatcatttctgtaacactgcttgcagtgaatataccttttcagttacatagcatcaaggtaaaaataagaactggaaggatcttgatattccctcatccctgccttgtcactaacagggaggatgctgattccctggatggacatgcagggactgtgatgttctcccttctctgcctatcacacacagcagagacagagattctcagagaaactgccaaaatagggcactagaacccaggtcccagccatcctgataccacgggattagcagggagacaaagaacaatcatttaagaagatcttaagtgacactatctctaccagtgtacaaatggcactgagtagcactgacataaacatctacaggacacatgatggatctgcagagagggactgcagaaggcagtaagggctctctgtgtctccgtcatcatcagcactggggaggtaaagggaagcagaggatgggaatccacagagactgtggaccagtctctgtcttggctcccaaacagagaacaaaatgcagcagagaaaggtgagattgcagcaagagcaccagaagaatgaaaaggtgtttggatctggagatcagagctgtcagactatgactgtccaacaggtaccttgaggtgctttctagaaagctttgttgtgaggaagggtacccttgtgaggccaagaacaaactcagtcagtgactacaaacagagccagggtcacatgcacagtcacatgccagttactttttttttttttttgtaacacggttcccgttctgctcaggatgaaccctttcctgtggcaaaggtaccaggatttcctccttgtccattactggtttaaaagcctgctgcaccgtcacagagcctcctgggtagcatccgtcctctgttgtggtggctaggaagaaatgcccaaacaactgtttggcgacatgatgagagtaaccctgccatttgaaaatctgctgtttgaatcctgtactagccccatgaaaagagatgggcagatgtcctacagcgctgagtgtgtggcttcaattgggaaaatcatgagtcattcctataaactgactaaaacgttttctttctttcataatttagccacaagcattaattaaagcatccaagaatatgtatttggacccataaaatcttcataatgagccaatgcaaaaggaaccactgttgagcctttgcagtttggaaaatgtatttttaagtaacggtgctggagttaaatgtttttcttcagcaaatttaaactccggaaaggaaaacaaaagctcaggtgtgactccaactgcttttaagagtttcctaaggcaaggtggtttatttccctacttacgtgtgagagatagtcctcaaccatacaaaatattacaaaagcttgttgcgagttggtgttaagaagaaaaatgcatcttctcacagaaataagtcattacacatgatagaaagggagccagtgtggatatgcatatggctgatctgctagaaaataaactggatataggcaaaactgagaaagccaggatcctcgaacaaggatttatgaggaacaactgaccctagataagttctactttttcctgagccttagggtactgcttgaaaataggttgcttattttttctaataagtgtgtgtgtgtgtgtgtgtgtgtgtgtgtgtgtgtgtgttcatgtgtgggggcacagtcacacttatgctggggcacacatgtggaggacaaaggacaacctttgggtgtcagtccttgagtcatcttgtgtgagccagagtctcttcaccgtgtgaaccaggctgcccggccctggagattctggttatagtaaacctggctcaaatctgaggtattgaggaaggcatctcagaagaaaactgagtaatctaagacctgaacgatgtaaactgtggacacacagcaaagaatcagagggctcaggaaaaacagtgctttccaagtcagggatctgcacacacaaaatccccagcacactcacatcaggctgcagggtaggaagaaaagggaggattccctcttagacgagacaggacagtttccattctgaaaaatgttgtctgctatgtaggtgagatgtcatatcctacaggtgagttggtacatggtgtacaggttggcagggaagcctatgctaaacacagacacggggcgggggtgtttgtgtgtgtgcaggtttggacagtgtgtgtgtgtatgtgtgtgtgtatatgtgtgtgtccaaggacagcaggacccaagaagccttggaaggaagtgtcacaaataggatgggtttattgatcaaggatttttgaggaagtcaggtaagcagaggcctgcagcttcccttgcacttctccatatcactggggattcggggcaaaagtggtttcccagcagggttcagaagccagatggaacaggtagaggaaggtaagaaagctgcccacatacacagaaagtagcctttccagaagactagtcgaggcagagaggcaagactgtgtgaaaggtgacttcagggagaacctctgtggtttgtttgcttagatggcaggtgaaaggaggcaatagagagacaggcaggaagtgtgagagaaaggaggaaaggaactgtagggaggtgtgtgatttgaatagggatggcccccatagactcttgtgtttgaatgcttagcccatagggagtggcactattaggtggtatggtcttgttgaagtaggtgtggacttcttggaggaggtgtgccactgtggaggtgagatctaaggtctcatatgctcaagctacacccactgtacagggcacagtctctcctgctacctgccaaactggatgtagagctcttcactccttctccagcaccatggctgccatgcgtgctgccatgcttcccaacattacaataatggactaaacctctgaaactgtaagccaagcccaattaaatgtttcctttacaagagtcgccatggtcatggtgtctcttcagagcaatagaacctccaactaagatgagaggttaccaaggagacagtggtgagtggtgtcctaaatgcaagggaaggaccaggccccagaaggaagaaaagtggtgacacggagatgacccggtagacttagaaagttgttccagtgtttttagggagctgagcatgttcccatgggcttccttcacatggaggaaggcagagtgctcctctgaggggagaagagaaatctagacaccctgaccaaacattgtttgccctttccttggactcctccctctccccacagatccctgttcccttcatcttcaagtaatacccttcccaccagctcccttttctagatgttcaacatgtctggcttcctatctagctgaccagatgtttaattaagaggaagcaagcagatgaaattggttcatgttaaggttgctctaacccatgcctcacaacccaattggaaccatttctgttagcaaagcaacccttaactccaaaagtttcagactaaagaacggagtgactacctggggggtgggggtggggcagcacgaaaccaggacagaaatctggacttcacctctgagggcaccttctacccacaaatttccaaaaatgaccactgcagttcacacccccagctggggcaaactgggcctctcctccagtatagcacctcccactatgtggaatccagacagtaggacatgcagcttgtccacaatacctcacattcagttgggtttgaccttgtgaatggtggcttcacatggtgatggtaacactaagcagtgggtcgttgctgcatttcctcatggtcactggaactattgaagcatgcataagctggataaaacagttctgtgagctgcatgtcaaatgtgtggcactgtgggcctgctgcaggtccttgggcccaagagtgcactaacacacacaaaactccgttcagtgaccctgacctctatttgctctgtgggctcagctcagatgtcaaggttgctgcctttggagtcagaaagtcttttaaaaatataatgtacagatcctacccctccccgaagaactactggctaccgatggattatgggagatgggcagccactgtcttcagcactccattaggcaactccaaacccatggctacacaaataagcctgattaaactcagtggttcacaaaacagaataaaaagacatactatggaaaaggatctgtatggaggggtggggggaggttgttgatggggtgaaaggcaaagaggagacgatgaagcaagagaaatcagaatgcattaaatacaggtatgacattgtcgaaaaataaattttaaaaattactatactacaacaacaaataataatgttaagaatgggttaagaaaaatactgccatttggaaatacaaaaaggtctcaagacaaaataaaagttatctgtaattctaattggctatttcacaaggatgattaccgggaactatttagtgcttcattttagactttgttgctgaccgcccccccacctacacctaccccatctccatccccccttcctacctttctccctgtcccttctctgtccatagctttctcattaggggttgtgtctccatccatttactcaccccgccccttttcactgagctaaatcaggaaatgtaaaatctgtaacagaagccttttattcccccccctccatctttccttcctcttctgccagtattcctttatcttggagtgtttccatttttatacaagttcaattcaaaatgtaaaacagtttatgcttttcgagtttgatttcctccctacacttgttaaaacagaccagtcaaagaaaaaaatgcccagattatgatagatccgcctccaagtgcatcacggcttcaattttgagtcttaggataatgatctgccaccacatgtgggttataacttgaggtttccataaaaatgcgtcttgatgaaccaactctgccacagtgccaaggagctagcgtgtctctggacgtcccaggcctgcctttcggtctgtgtggtgaggacagcttgctcaggaaggcaaacaacaggaaaaagagattagggataggacttcaggtgtggttccggccccgtgaggtgagatgctctctgttctagcagctttagaaggtagccattgggagctgtggtgctttagaaaataattatcttatttaagcctacacttgtcagggaagttgaggtcagccacaaagccatcggaaagaaggggctggctgccagagagaacagtttctttgcaggggatggggggtggggtgtcagtttgaacaacttggcttttgaatctagtgacctcctgagaccaggagtctggaaagattaaacacggagcaaactcaggatgcagttggctccccctctcccgactcaaaacaaaaacaacaacagaaatactttaaacttcccctgccccctcaagctgtctgtcatgcttctgcttggattattttcattagggtgtgtttttctgatggaaggccagggccttgtctttgtgtatttgcagagtgccatgtctactcactggtctttagaaattacagacaataagaggaattcggggagctggcagccccacctcacagcttttctgcactgaggttctgcccacgaaccagaatggaatatttttataaggcaatattgaaacattctaatcccaagaaactaaaggaagcctccattaactggatgtaaaccagagcctgtggttggcacggggtcgctgccacttgcatgattcgctggctgccacgctaacgagggcctgttctgtggttaggaaaaaggcagcctgtccttccctgggagtgaacctcacaactgcacgacacagtggagggggcaggtgagacttcatactgcccctgtcctttcagagccagcctcctggagatccagaagttcctgggacaaacttttttttaatttaaattagaaacaatcttattttacatatcaatcccagtttcctctccttcccatcctcccatgcaccacactgacctccatcccatcccccttctgctccccagggagagtgaggcctaagatgggggatcatcaaagtctgtcacatcctttgggacaaggcctaggctgtgtctagcctgagagagtatccctctatggggaatgggctcccaaagtccattcatgtactagggataaatactgatccactaccagaggccccatagactgcccaggcctcctaactgacacccaagttcagggagcctggttgggtcctatgctggtttcccagatgtcagtctggagttcacgagctcccccttgttcaggtcagctgtttctgtgggtttcccaagcctggtcttgacccctttgctcatcactcctccctctctgcaactggattccaggagttaggctcagtgtttagctgtggatgtctgcttctgcttccatcagctactggatgaaggctctaggatggcatataaggtagtcatcaatctcattatcagtgaagggcatttaaggtagcctctccactattgcttagattcttagttggggtagtccttgtagatctctggacatttccctagtgccagatttctctttaaacctataatggttccctctattaaggtatctcttttcttgttctcctctattctttcccctgactcaaccttcctgctccctatgtcctcctctcccctcctctcctccccttctcattctcctagctccctcccccattttcctgtgctcccaatctactcaggagatcttgtccctttccccttctctgggagaccatgtgtgtctctcttagagtcctccttgtttcctagcttctctggcagtgtggattgtaggctggtaatcctttgccctatgtctaaaatccatttatgagtgagtacatacaatgtttatctttttgtgactggattacgtcattcaggatggtatcttctagttccatccattttcctgcagatttcaagatttcattgtttttttttttctgctgagtagtactccattgtgtaaatgtaccacattttctgtatccattcttcagtcaaggggcatctagattgcctccaggttcttgatattacaaataagactgctatgaacatagtagggacaaacttcttactgtgctcaactcgcaggacataggagccaggacaaaaagaatcagatgtcagggagacacagtgtttggcgtgagctggggagaactgcaaagccaatccctacagggcagagaagaggggcagagacatgtcttcccttctgcccttccgtcctccttccttccttctctccctccctttcttctgtctttctccttcctttccctgtcctcccttccatcctcctttctcccctctgtcccttctttctgtctgtctttccttcatttccctcccttccagcctcccctccctccctttcttctgtcttccttgcttcctgtctcctccctcctgaccttcctgctccttccctccctttctgcctcaaactttcttcctctccaccctattctcaattctcccttctcctctctctccctcttctccaatctttcctttttctcaactaaaggtagtaatttgtgtgctccttgctttaatcataggtgtggctttataaagacagagataacttcaaaacaacagttgagatactaacattgactgttgagacagtgcctgatattcgacgtgtgagttgggcagtgggaaagatgccaaagtcttcattaccaaactctcctcccccagaagtgtggaatgccagcagtgtccagcattgctgagcagagcaggttaacactactcaggagatcttgtccctttccccttctctgggagaccatgtgtgtctctcttagagtcctccttgtttcctagcttctctggcagtgtggattgtaggctggtaatcctttgccctatgtctaaaatccatttatgagtgagtacatacaatgtttatctttttgtgactggattacgtcattcaggatggtatcttctagttccatccattttcctgcagatttcaagatttcattgtttttttttttctgctgagtagtactccattgtgtaaatgtaccacattttctgtatccattcttcagtcaaggggcatctagattgcctccaggttcttgatattacaaataagactgctatgaacatagtagggacaaacttcttactgtgctcaactcgcaggacataggagccaggacaaaaagaatcagatgtcagggagacacagtgtttggcgtgagctggggagaactgcaaagccaatccctacagggcagagaagaggggcagagacatgtcttcccttctgcccttccgtcctccttccttccttctctccctccctttcttctgtctttctccttcctttccctgtcctcccttccatcctcctttctcccctctgtcccttctttctgtctgtctttccttcatttccctcccttccagcctcccctccctccctttcttctgtcttccttgcttcctgtctcctccctcctgaccttcctgctccttccctccctttctgcctcaaactttcttcctctccaccctattctcaattctcccttctcctctctctccctcttctccaatctttcctttttctcaactaaaggtagtaatttgtgtgctccttgctttaatcataggtgtggctttataaagacagagataacttcaaaacaacagttgagatactaacattgactgttgagacagtgcctgatattcgacgtgtgagttgggcagtgggaaagatgccaaagtcttcattaccaaactctcctcccccagaagtgtggaatgccagcagtgtccagcattgctgagcagagcaggttaacagggacctgctgtggtttccgaaggactcaggggcaatgcccatatcacccacagaatgcatgtgttccttcttccaaccaggacacacactggagaggctggaactgccccaaagtgggcttacaactttagggcaaccagccccagttacggccccacaagaatgggaaaatttcttctgaaagctgaagtaaaccacatttaaggaataggtgtcactgtggtcattgcagagaacaccgatgtccaccccaggcaagcactgcactcctgtcccatgaagccactctgtaaagtcccagcagagccttggagggcagcaacgtttgggtttcattttcatcttaggagccaacagctgcaacagctacccaaatgcaaacctcacagaatcaggctcgaaaactggtaagtgttcgctctcgggttggttccaactgtcccttgttgaggaaaagcagttaacaatgtaagtttttaaacaattgttactattataagagggttttttaaaaaatgagaacattgttcaatgtagtcacattttctttctaaaaatagacaaataaaatgattcacagatgttgatttatgagaaaaatagtaaagaatataaactaaaatgtgcttgaagaagggggacagagcccctcattagaaactattctgtagaaagcgcccccactcctgttcctgccaggaaaccccaaggcccagcaggatttgtggcactggactgagagcatgtgtgctggctgtacacacatgctgcctctacttgtggcaccttgaggaccagggcacaagcagagatgaagatatgagctctaggcagagcacacactgcagaagtggaccctgctgaagcctacagcttcctgaaggacatagctggtctgcatcagaatcacatagagctggtcatggtagtggacacttgtcattctagcatttgggagtcttctgaagttgagaacagactgcactatgtattaaaccctgaggggctagggagaaagatgggccgaggtaacgagtctggagggctagttaagttaaatggtgaccctgcccctatgcttgcagcctcaggtcagtatatctagggtcaagcccagaaatgtgcacctggcacttacaatccaggttaccctacaactgcagagctcacacttggctttacataataacattctcagagggaaagcattggcctcatttttcccactttcaggatcctgcctgccattgacagttgaggtccatttgtttgttttgtgtgtgtgatgtatgtgtgtttgcatggtcatgtgtgtgtagaaggtgcatgtggaggccagagatcattgccaaacgtcttcctctagtgatctccaccataatttttgaaacagtatctctcagtggactctattcagctagactggctggccagaaaatcctcctgcctctgagttcctggtgctagggctacaagctcatgccaccacacccatgtttttggatttttggggggggtttggtaggtactggggatcaaactccggtcctgatgcttgcgtgttgagcaccttatttgcctagtaagcatctccactggccgctgtcctgttctattaagggtgtttctaatgccccaatttttgaatcagaaaagaagtaattaaaatgactgtgcccacattttgagtgagactgtacagtttctttataatgaagcatttaatgcacatgctacactcaatccaatgttgctattgatagaagatgtggtcctggaaatacagccacatctctactatattgtattactatagtcccatcctacctgtttcaaccttagggctcttcccctaagactgaatctcctggggcttgaatttgttttgaccaatgaaatgtgagttagaaatggagatgctccctggaatgtatctttaaaagctgtgctttattctttccttcctccaccttctgccatgactacagcatcccagacaggaacggttcctttagtctggacctgagtgggaaagatgagtggtggcctggggagggcacagtggcatcagagcccatagcaaccagaggtgagaaataaattttggttcttccatgatctatacccacagagaggagtggttttagccacagccaccgactcttacagctttctcactaatattggcaaaatcctctgctgggtgtggctgaaggaaacatctctgtccggttctgtctggaattttctactgtcatctgaattccctatgttccacaccactatgtgaattattaggatggccacttaatattaaatcatgagtcgtcttgaaaatgctcacagttgagggttgaaataccaaaatgtcaacagctagatctcactaagttaattcttagccacacggaacagcacactaacttctgagcacttcaccaccatggctgggctgcagggccacaactgcacccatgctcctatagcctctccatttccctgctctaaccacactgtaatctgtctatgtgccttcatgggtcagtggtggcataaaatagtgtttatttgcttctactttgtggtagcagaataatgacaatataaaaatcagttgagaccatgcttttggggctccaatacggcttccatgacatttcctgtatcacattatcaaggatctctgtggaaaatgggattttattgcttaaccatgccatgtcccccactgtgctcttccagggtcatacatcactgtcagaacatgcccgtgagtccagatgggtgggagagaaggggtttaactgctgactagctcactgtggatcgccacaggtcacagtgcatctgagttctgtggtgaatgacccacttttcacttaatatgactgggtgtttaccacaccaacgtccaggattccgagcaccaagatgtcgcatgctagagtatgtgtgagcaagggatgaaattcttccaaagaaaaggtctgtaactcagttgggaaaaagaatcagtgggataggccaaatcacagatgtttccctctacttccagctgttattgcttggtgacgaatgcccccaacctcatgtgatgaaggtttggcctctagtgagttgtgttgagagatagtgggacttttaaaggtgacactagtgcgacatgctaggtcactcaggatgtgcctccacaccacccacctcctcttgattgttccttggtcatgacctataaggctttgctctgccttgtgctgctttgcctcaggctaaaggagtgaggttgactgaccagggatgagaaacccccaaattgaatgcaaacaatcttctctcttcctgagcagactatcccgagtatctgatggaaggctatcatgcttaccccattgtctcaatgagatgaggctgcccatggctctgaagtccatattacaggtccagcctcaagtctaggaggacttgatcccgcaattctcaattcaacaagtagccaatgggcactcagaacactcaggtggtgcagtgggtgcttgggttacatagagaaatggggagcagctgagaagtagaaaatgggaccagagttatgccctggaaatatgagatcaaaatgtcaatctatagatcctaccaggaagagccattgccacaaagcacatagttccaaaggtgacacaaccaaaaaaggagatgacaagtggtttttttctgcctctgtagttcacctcctctgggtatgcctcagattttcaccagggcatggtaagactgctgttatttctctgcattttctttttcgggccagatcagtggctaatgccattaacttcatttcacagaaaacaaaaccagggctggtataggaggagcaggcagcaactcctgaggctctttcaaagctgatgagtcacatgagcgatcaaatgaccagagtgtttctggaatgaattagtagttgttcacagcattccggaaagccgtatcatgcaaagccatgctgttctgtgactcattccattccggtctgcttgggaagagaagtgaaattagatagtgtcttgatctatcttctatttctataggagaatgcctgagactgcgtaatttataaagaaaatgcgtttgttttggcttacagttctggaagactggaaagtctacggtaaggcagctgtatctggcagtaagtagatgacaagggaaggagtgaggcaaagaagataatccaaaccaagacctggaggccagaatgaacacaggctgctgaaggggcttcagactgcttcaggtccatgctgtgaggtggaaggagggagcaatgaggccagtgaagaaggcagtggtgactcagggaacctggctttagtctgctggtaccgagaatccctggttgacctggtttggatttaagctgctaggggttgagggggagatgagataataaatgtctttttcttccagtttatttttgtaacaacatttgtacagcaaacatccttagaggacagaggtctagtctctggagcaaggggaaaggcactatatttgaactccatggaaagatatggactccttaggcttgggtttctctgcagaggcagaacactagtcaatgtgtggcacctacctgggtcactccacaatgcctctgtgggacttgggaaacagagagaatgtgaaagtttcctagcttgccatgctgggagttagaaagccaggaggcttgaatattctgtccacatcaatgaaactcctggcattcaacttgttggctttcaagtaggtaaaacttcttccctggtggttcttagatctgtggttctcagatagctattgctgctccaatggtttggaagctgttgtaatattcaaactgagggggtgaaattacctcattctatttcacatatccaagtgtgtgaaactaagaatagcctcaaaagatgccagaaggatttagagaattgactgagcttgtgctttataagagcctagaaagccaggattctcagtgcatcttaaaacacagatgctaaaggtcaatatatgtatgtagaatattacatgcatgtatttgtgcgtgtatgtatgtataaatgtatgtgtatatattaacaaaccagtgcaaatggcttcccagaatggatgagggacaggactttatccttagcattgttggataaataaataaataaataaataaataaataaataacaacccaaacccaacaacatttggaaagtcctgaggactttttaaaagtagtcttcaacccaggcttactcaatatatatttaaaaggtgtttgtagggctggagagagggctcagaggttaagaacactggctgttcttctagaggtcctaagttcaattcccagcaaccacatgatggctcacaaccatcagtaatgagatctggtatgccctcttttggcctgaagaatacatggagacaaaacaatgtatatataataaataaatattttttaaaaaaatatttatattagttatttatattagtttttcacccctgttgacaattcccccagagaagcataaaagaaggaatattttatctcagctcatggtttcagaggtttttcaatcagttacttggttccattgctcctaggcccatgctgaggttcaacatcatgacagtgagcactcggttaagcagatccgcttgcttcatgatgggcagggagcagagagaaataacaatggaggtcagagccaagacagaccctttaaaggcacactgcctgtaatctactttctccaacttgtcctcacttcctataattccaacacctcccagcaggtgttgctcacagtttgaactcatgataaccctttcattaagtcagagtcctcctggtctctgaaatgacctcagggacacatccaggaatgtcttttgctaatccagggtctctcaccttaataaagtcgacaatcaagatcattacaacatctaaccacagcagtaggctaaagaagtcaaaacccacatgctcacttcagtagcagtataaaaagcacttaacaaaattcaaaaacccattcaaaataaaaattcctcaatggagggaaacttccttaaatcattaaagaacatttactggcatcactgtggttaaaaatggaaatctagtcaggcagtggtggtgcacaccttcaatcccagcacttgggaggtagaggcaggtggatctctgagttagaggccagccttatctacagagcagattacatactagaagtcctggttaacaaaataagacaagaaaaataaatagaagacatacaaatcagaaaaggataagatggtcattgtagacagcacgattatgtgcttaggaaatcctagggagtcactaaacaatctgcaactagtaagccagcctaaggggctgaacagctcaaggtcaaaagcctcatttttcatgggtgtgcacatgtctgttccaacattgtctcacactggcactctctcacagctctttacatggtgatgtcataactcagtttgtcaatcactccactggtcttccaggtctttgagagcaggaagaagatggctcagcctctctcaatttaggtatttaacaacttccttaccacatacaaacttattcactcaaagtattcactgagcatgtatacttatgaagtgagtgggtttctcctccccaaaaaaaccatctagtgagaacctcatgtcaccaactgtttcccagccaaagttcttcctgatgaagacaaggagaaatttattttctctcttgggtcatttctcttttgaggtatgtcactttacttcagtatttggaaatgtccaaaatctgtaagcagataataactgctcatttgtttttatccagttatctcagggagcagccagaaaaccagcagaagtcagcgctggatctatatgacaaacacaacaaaatctcacatgtagattctaacattgcctcagtcctcatgttaacaaaatgattttatacaatctcatgctgactgtaaattactgctcagcttcatactagacgaactgctacatggcttgacaaggaatgtcactgttgcaaattacaataatagtggccatgtagcaacatgggtggggcctctcaaagagggccagaaagataatgaaggacactagagaacaggaaggaaatggacaatgagaatggatgtgtaaggcattatgcaaaagctttgttcactgattcctttcctacacaggcaaacctgtctgctgccctcatagaaggctttgtcttggaataaggccatgctacctgagaaggaagaaaatgcctgttgggagagcgcctgttcttgtgagatcaaagcacttcataacagcatcatgatttcttctattgatgacttagatcccaaatagagttagggactggagagatggatctgtggccaagagcactgactgttctcccaaaggacccaggttcggttcccagaactcacaaggtgctttacaaccatctgtaactctaattccagggcagctgatgtcctcttctggcctccatgggcatccagcacacacaagcatgctggcaagacactcatacacataaaataaaaagaaatctttctctaaaaggtagaataattctgtcttctttgtgtagtcctggctgtactggaactcactatgtagaccaggctggcctcaaactcagcgatctttctttgcctcccaaaagctgggattaaaggtgtgcaccaccacctggctctccctcataacttaatctcactttacctggactcatttgttaaaactcctttgcaataactgactgagcatagaaaaaaattagtgtatcactaaattgttaggtaattttttgatgtagtagtctgaaacatgctactataagacacgggcataacacagtgcccagtgtcccctctccccagggttagctctgtgtgctgagcagcgtgttctcaggaagaagtaagagggtccagtgttctccgtagccacatcagctgaccatcagtgaactaaccaccgtaactggcagattttaataagaattcagttacttttgctctatctgcagacagactatttaccgttggctaactagaccacttcctaaacactcggagaacggaaattaactttattaacacttcagaacacaaggatggtaaagaaacatgagcattttcctcacataaatataaatttccatcttagtccatcggccttgatttttcaatctgtattagttcagtatgtacactgcctgccctgtgctctggagaatggactgaagtttttgcttatgggtttagaccaacatttaattctatacgttgggcaagattgggtcaatttttttaaaaagcatttaatgccaattaaagagtagatttgggggcgtttctttggtcagaatgatggagtgagtctaggtccttgttgtatactcatctttcactcggcctgtgagctgcactcggggccaacaagtgatgcttcacattgcttattcccctaagatggaatccactgcttcagaatgtaaaagggacctcacatcaagaagccatgaggttcttcagagccccatttaaattatctgttagcttccattaggaggggtggtcaatgggtctgcacaactttgatttatttagagagtgtcatatgtttgagaactgccttggcaaggaactgtgctaaacatagagatacacactgcatgcccattgggctcacattaaagggaaaatacgcaataggggtttacctcagtggggtgaggcttgatactttccagatggttgactccaccagtgagctcaatagaaatatcttcagaaaaagatgctcaaatattaaataagcaatgcatatacacaacgccatgatctgctacatttctttacatctgggctgggagtgtctcttgtccctagctgctgatggggtggtcttctctgtcagtgggaggccccattagatttcccattaggaaaattattctggcagggtatgttctagaacattgtccataagtagatgcaggggcttctcttgggggtgaagaagcagagaagagaagaaagcagcaaagaagaaatgttcccttgcgtgtgggagtgaaactgaacatgagagtggtgattgctttttgtagctagggaaaggcccataagcacacagttagaatgcgcgggaagttgatgaagcaaggattctggctttgccctgaaatgagccagccagagcccagagaaccaatgacaggacagaacattatgaaaagggagcaagggtcagccctttgtagatgctttcttgcatctacataggaatcccacacctgtaatccaagcacttgggagtctgagacatcctgttctgcacagttacatctgtctcaaaagtgcaaacactatcaaagtccacagttcaggagttctaggtagtgacagaaacctacccctctgtacatatgtgtatgcacacacacgtgagcacaaatgcactcacatggagaagagtcagtacatggcaatctggaactgatcccctcccccgggaagaggctgggaaggcctcacccaggcccccaaccccaccttgtccctagtgcctgcagcattcccttcagcatttcttcagaggtctccaggctgctcagtcagattttggctgcagttcatagaatgctcaaggccaaagaatactgtcgtggcattggggttttgtcacaggctctgtcggagctggtgaggtgctgtcagctctgtgtgtttacacaatccagttaacttcaaccccaaagaatattttccggataaagaatagaactgagggtcagtatattgtgtgaggaagccagatccagaaagacaaatgtatgtctcctctcataggtggaatctagacaacatgtgtgtgttgggggaggggtgcatgtacacatggatagcacaaagaggaagaagaagggaaggatcaggaggggaagagagaaagggagctgacaatagtcacagtacatgacagacttggacaaaaatatcattattaagtcctatcactgaatattcataggttatattcatttaaaaaatgtgttggtgtaatggatttaatgaaatgattatgcattgaattttttttaaattaagacctacttgggattttcttgttttgttttgctttgttttgagacagagtctctcttcatagccctacctggcctggaactcattatgtagactcaagctggccttgaactcacagagctctgcttgcctctgcctcccaagatttggtattaaaggtgtgtccagctaggacctactttgaagcctgttctctgtaagaacagggagatgggtcagtgtcagtcttcgggttgtagcatttgttgtgttaaccaacgggagtgaattaaaaatgggtgatgttaagaaaggcaagaagatttttgttcagaagtgtgcccagtgccacactgtgaaaaagtgaagcaaacttaagactgggccaatctccaaggtctgtgtgggtggaaggcaggtcagacactgtattctctcacacagaagcaaacaagagcaaagatgtcaccaggggagagggtacctggaatatttggagaatcccaggaagtaatccctaaaacaaaaatgatctttgctggaattaagaagggggaaagggagacctaataatatcactgccttatttatgacaaaacgaacacctcagggcttttaatgtgtatcataacttaattcatacaccagaattcagatcatgaatgactaacaatgtttttgtttgacagtcctgatttaagtaaaattgacttgtggtgaagtggatatgatctttttaaaaataacaaaagcaacaacaaagaaccaacagtagttgaaacagaaatctccaggcttaagccctaagctcctgaagccccatgttcaagtccaagtagatacatgctgatttacatgtttaacaaataccttggtggttttcattgggatttgcaatcccagagggctttagtgcaatacccatgccctcttcagagcttcagtgatcagtggttcaggaactgtggactggagcatagatgtaggtgagatttcagagctcctctcagaaggggagggggtgggggttggggggttgttcagcaggttttggggtttagctcgaacttgagttgtcgcatcactagttacctgtgcaactccagacaatgtaattgatgtctctgagagtcaagatatgatttgcatcctaggattattttgaaaattaacaagctaattctgtaagctacttgccatgttacaagcactcagtggattttactttcattattatttttggatgtgcccctatgttaataactggaacacaatgaataaagtgcagttccgtgccatgggtgggacagggtcccaatgtacagagacagatagacacagaccatcgggtaatccatggaattcatagagttccataggaatccacagatgacctgaccttcagcccatcaccattcattgacaagatggctcagtctctttgtccagaggtaacttactctcaggaggtggataggctcggttatagaaattgattccttgaccaggcggtggtggcacatcctttaatcccagcactcaggagctagaggcaggcggatctctgtgagttcgaggccagcctggtctacagagtgagttccaggatagataagactgtttcacagagaaatccgttctataaaaccaaaaaagaaaaagaaaaaggggagagagagagagagagagagagaggctactccccactggccagttgcctgtctgtgtggatcatcttggaccactctctggatgaagaagatggtggggatgggggatgctatgaagcaggagagggaagtgaactgagtgatgagaagaaaaggactgtaactcctgtgctggccacctctagggttctccttgaagagtccttttgatctgagaggaggaagtcagaagagcatgagcataatttaatatcagttctgaacattgtccagactctaataaggccaatacaatctcagttaaaaacagtaatccaattttgctaaagcataacagcattctttattatttggatagtcccattttaaacttctaatccttcttttcagtttttttatcctaaaacaacgtgaaacaccatgaacggctgaaatgaaaatgatgaatcagcacctcatttgcctttgataagaagtctaagtgattttcaagcttggacttttaaaatgaaatacattgcattattatatgcatttgctcagtatccatacagagtgtgcaatcttacagaatttctccaatccctactggtaattaataagtctgttgctttaaaaatgcttctgaaaagaatgaagtcatgcatcaaattaaatcataatgacactacagagtagggatccacaatgttccctacagtatactcgtattttgaaaaagaataagaaaatgttattaagagagaaatttgggttgggaggactggatagtaaagttgcacagcccagtttgcctggcccagagagaaacttctggaacctacagtcccagttcttacatatgtccatgagcatgatccatgttgaaatgttctaaagaggaaatgacagtatactcccatcactagccaagtgctgcagtcaccattctgccatcttgaaagggatctgaggagtaactaacattccaggcaaaaggaagtaaatgaaatagctggaggtttggctgcttgctggttttgctcttggataagccacttggtctctcttcttatttgtaaaatggggatctgtgaagattagatggactgatacatatgagaatacctatattgaggaagtgctcaatagatggtagctgtcactcaatagatggtaactgtcaatagatggtagctgtcactcagtaaatggtaactgtcactcaatagatggtagctatcactcagtagatgatagctgtcactcagttgatggaaagagaagggggaatagatcaatcaaggttcctgcccagtaaaatcctttgggaatggtctcagttgagtttcaaggggctggatgtctatgtcaagccttgaaatcatttagcacctccactttgccctatgagcccctttgaccctattgcccttcttctgcctgcctagccaatcatctcttagaagtgatcctaagccatacaagtggtgtgctgggaaactagctctcccccaagtccctggttcataaagtctgttgcctacagtggtgcaaaccctcccactgtgtggaattcaagccacctgattgttttctgtaagtgtgcctgcatcaagtggctttcttccaagtagtacagtgtgggagagatgagcaattttacagcgagaaaagctgactccctccctcagggggtgttcaaggtttacctcaatagtcatgagtcacactggcatctgtagccttcacaggctatgatgacaatggcaattcgctgatgggatcttcttccccaaaacatatgttcctcaagccagcctgaaaaaaaaaaaaaaaaaaaagcaagaaatctcctttaaggggctttatataaaacactgaccaatactcaaaattacgaagattggggtatggagggatgactcagtggttgagtacactggctgctcttccagaagaccagagttccatttccagtacctacaatgtgactcacaaccatctgtaactccagttccagggaatttgacaccctcttctggcctccacaggcaatgcaccacacatacatgcaaacaaaacacccatagacataataaagaccatcccaaacaagtaaagtctgagaaactgtggcagtctaaagaaaaagaataattacatacaatgagttaccctggatgcaattctggagtagaaaggaacactaagctaaaaactaaggggccaggcagcagtggagcatgccattaatcctagcacttggaggcagagagaggtggatctctctgagttcaaggccagcctaatctacatagcacataccagaaccatcagagctacatagagagaccctatctcaaaacaaaagagcaacaaaagaatcaaccaaataacaataacaacaaactgtgtgggagggagacccagcgacagtgttggggaagacactgaaagaaaacaatgtttaaaatttataatgatacactcacatgcaaatatgcgatgctatgatgaaactcattactttgtatcctaatgtaaagggattttttttaaagaataatgtatggatatcggtttatcaaatgtaacatataccaggtaaatgtgaaatgttaacaatgggaaactgtggaacacatggaaattgatttactatcttttcaatttttctatgaatctaaaactattctaaaataaaagattgatgtctaaaaaaaattctgaatatgtaacagtggaagtggaccccctggggccagtatggtgggatccagctccatccagtactgagcttatctcaacagaaacttgaggccctgtgggggtggagcataagatttgctcaactgtgcatcctgcggctggaagcaactgaggatgctgatggagtgtctacactcagacacgtagaaacagcctcgctctgcagcttcctagctgtgtggtcttgatcgacctccccacccacgtcttagtttctcagaccataaaatgggtgtgctaagacatcttcatataggtttcaggctttgggagaggtgacaccagtgagtctgagtaagcgctatgaacagcactggccacacagttctgcttatttcttactagtccttccctgcccttacttagctgctaaggcttagctgaagtgttcaccccctctaaagaacctgcatccagctggtgacagaacttcagtccaccttagctccccctaaacatgtgttacgctctggaaccctcctcctcccctctaagcagtgtatagttcctggctgttctcttctggacatctttgagcctgcaatctgccagctcccctttcgtttcctttgaaagcaccattctgcatgaattggtgagaactgcagcacaaacccaccactgttgactcaggaactcaaatatttagacttcgaaaggacgtgcaactttctctgctgtttccctttattagccgtctcagaagggtgggagataaataaagaaccccacagaagactggggtcccaaagcagcagctgtaggaactgaggcgagccagaaattcaatatgtttagggctcccttgtgaaaacacaaaaacaaaaataagaatgcctcccactgctccaacatcgcctttcctgtggatgccccccaaccattctctttgaaaacaaatgggaaaagccaactgttgatgacagtcactgggggcgtaggggatgtccctggtgtagaggaggcatgcttgttcacaaaagaggaattctgccttgactgacaagcccctacaaacaaaaggcacaaatgtgtgtgtgtgtgtgtgtgtgtgtgtgtgtgtgtgtgtgtacacttacgcgcatgccccacacactaatgggtgaactggaggcagagctcaacaaaagtctggatttgatttgtaggactgtgaattgtcttgaatgttttgaggaaagtttaaggatttgggagctatttgagaattagaagttttatttgaggggcatttgcggattaggagctggttatttgggaaacattaaggaccaactttattctcagctgtttctataaaatccctttgttttgaagtctgaagttctttcaaagagaagtttgctcctgagatttgagacctgcgatgagtaaagccttaaagatggaaaagaaaatgacaagggaagactccgcctccacctgcaccctgcttgatgttctgctctaccaggcacacgtgactctccaatatttcaagattccacatgccatatggcgattttaagttgacagactgatttatagacctgtgattgctaaggagtttgtaaatcttacctgtgtgtgtacttccttttcatgggttgcttatgtggttttcacatgcatattttgtgaggttggtttgtttgtcttagaaatttagaagtataatatttttgattgaggacctcatgtatctgaggttggcttcagactcaccatatagaagaggatgactttgaacttcttgttttttttaagactacttatcttttatgtatatgcatcataaattcatgaagtgcccaagaaggccaaaataaggcattggatcccctggaactggatttataataagcagttgtgagttgttatgtgagtactggaaattgaacccagatcttctgaaagagcagccagtgctcttacccactgagccatctctccagccccagtcttaaacttccaaacttccttttcccaactccagaatgctagaattataggcatgtgccatcacacgtggtttatttggggtaggcaaacactctatcagccaagatgactgataagtttctaaacttagcattcttagctcttgttagactcaatactatatattttgacaatctatggtatgtagtttgtttactataattgccaaattgaatcctactgtacgcatacaccagaagctatttttccactctgagggagccctctgtagggttacacatattaactctatttctagtcaggatcaagtaagcaccctcgttctgcaaatgtatgtcaccacaccttttcatttccattgttttttttttcagaactgcagactttttagtagaattaaattcattcattctctctgtatgattctttcaattgcttcaaagcagataacatatttgacttccaaggagctaagtattcattcctgtttccacatttttgtgttccttttaccttaattctttaacacttaacaccaaaaggagaacagtgggaacacacatggtttcccctataatttgtaatcagttttcaaaagggtttgttctgttacaccagtctgtggtttttaaccccccttttacattctgaggcatgctaagatttatttgggaatgttttgttctgtttaattgatagctgcaacaagtctttctctgtcccacaagccaggtcccaaataatgatcaggagacttcttattaattatgactgctcattctataccttaggcttgttcctaaccagctcttataaacttaaattaacccatttagattaacttccattctatcatcttccatcttgtacctcctgattcctctctgtgtcccctagagtctccctctcacatagattcctcctcctcttccttctctccctggaaatcctgtctataccttctgcctagccattggccattccgtttttttattacaccagttacagcaacacaccttcacacagtatacaaatatcccacagcacataattatgtgtagtattccttcaatatttgaatcttattttcattatcattgtttcagcaatatatgtccatagctcctctttttaaatgtgatttgagcaggttgtggtggcgcacatctttgatcccagcactcaggaagcagaggtaagcagctctatgtgagttatgagtttgagtccagcctggtctacatattgagttctagactagccagggctacatagaaggattctgtctctaaataaataatcaaacaaataaaaattatttaaatttcttaccaatttatgtttttatcaattttatttcaatttcattggctgggaagtggtggtacatgcctttaatcccagcacccgggaggcagaggcaagtggcagatctctgtgagttcctagaattagttctagaccagccaaagctacacaaagaaactggaaaaaaagaaatttcctagagcatcagaaaaatttgtgttgtatttctaactagggttgtgctaaaactatatattaatcttgggataattgaaattctgttgacacttcttcaaagtagtctcttgtttcttttgtcttttcttggtgcataatcatctaccaaaaatgatattttgactgattatgtgcaatatttatttatctcattttaatttcttctcttgtagtatctaaaatgtctcaataatctcaacataactgaggtcaatgttgtagattttcaagttaatgtattgaatgcatctacaaataattttaggtattagctcaaggaaatatccttctcttcagttctctctgtaggtttggacttggagatgtgttaagatgatcatagtctctcttagtgacactaatgtacagttgggggaggtagggatgtaactggtagagttcatgttcaacatgcacaagaccctggcaccagtccaagatgaaacaaatacacacacctttatatttctcccttcatgtatctaagttgtaatttcccttattctatataatgtaattgtctcttataatcaacatatagtgttgacttctgtctttctacctgacttgctttgttttgctttgtttcaatgttgagggtggaacctaaggcttaacacatgctagacaagccctttaccactgcactgaaccccagctctccttctccagtttttacgttttctttctcaccttttttattgaattaaaatataattacctcattctccacccccccagctccctttcaaatccatggcctcttattctttcgttattgtgtgtaactttcctgtcatttctagaagacagtcttgcagcagacttcctggtcttctggctcttacatctttctgcccctccttctaggatgttccctgagacttgggttgtagatttttaattggaaaattcagtcattctctgcatttttgactagctgtggctttctgaagtggtctctatctgctgaaaaaactattttgatgagtggtgagagctacgtttgcctatgagtatcaggataagtgttagggtatagttaggtggaattatactggtttaggaaaatggcactagtcggttctccacggagatctacatggccttactaaccatgaatgataagctaggtttgtggtagttggcatgatttcccttctgttaaatggaccttaaattcaaagagacagctgttagttaccaccaagctataagcactactatcacaggttcagggatcttgccatgcaggttattgttgtggttcattgggtcacaactggtaggacaatcaaatgcattcctctcttggcactttgcatagcactttctgctactgtgaaaactattgctcaggaaggaagcttttttgggtcagatcccgttggattcctggaagtcttgtatctgaagtgcgtggtgtctccatcgatagggacttaccttcagtttggggagtccccaaaccaacaacttgagagaagatttcttaagcctattgctgggatttttgttagtctattgctcttgagaggagcattatgttgccaaatagcataacttcatttaaactatacacatatgtatacgtagacactcatgtatgatgtgtaattttaggtaactgtgaaataatatgatacagttttgtcatttgtatttattggtcttggtgtcagaattgtgcttcatagactattcgggccagcactgatacacttggagggacattgtcagtgtgaacacttgattgtctattgtaatgacttgacttattggtgagttggggtaaagcaggtccatggttattggcctcctcctggaagccagcctgcccacagagaacatgctttccaacttagaactcaaccatacattttacagggtacctccatatggggagcatgtggtaattccgtgctgtctgtggcagagagcatgggtaattctaactaagcttcagttttgagaaacccatggttgccacacatccaagccacatcctcaaatcctgcgtttattagctataaaactgttccttttatttccatctgtctaatttccttgcctaacaaactcaattaattttgactttcagtgcaggggaagggtgtctgttaggctccttcaaacaccagtaatgtgacatacactcaaaacagacaccaaagccaggaaaaaaatcatggccggacagtgagatggcttagcaggtaaagatacctgatgacaaatttgatcccagagaaggagagaaccaacttctaaaagttacctattgatttacacacacacacacacacacacacacacacacacacacacacacacacaattttaaaaatatctgttatgtgtactctttcctgccagctgcctgggtcccgccaccacttcagcccccaaataacacacgagacactatattaattataaagctgttggccactgactagagcttcttattggctagctctgtcttaattactaatctatttctataaaactaaatatttccacatggtcttatcttaccggagaaaaggtccaggcctcttactccattgtggtctacattgcgtctccctgtgcctatacttcccagaatcctcctcatctcctagacccatctatcttacttccctattggccaacagtgctttactcatcaaccaataggagaaacatatttacagaatgacatctcccttcaaaaacctaataaaacctttaaaaatagatagtgggaaaacaatattcaaagacaatggaaggcaatggtcatatgactgtgaacatactaaaactattggtatgaatagtatttgcttgaaatttatggaacgtgacaaacatctcagtaaaaatggtgaggaaggaggcagggtgggataatgaccaaccatcttaacttaatcagcaaggcccagtgaagtgagaatcactgccccaaaaatcaaagtagacaatacctgaggagtgacacctgaggtcaatctctggcctacacacacacacacacacacacacacacacacacacacacacacacacaagtttttgtacaaacaagataacagatttaaaacctttcaaaaataataaaaggcagtaattgtttcaaaaattagtgtgtttcaaaatgaagacatctccaggtgcatcatagtgaaagaggatgaccaattcttaaaagctaccaaaaagaaagatagatgaaccggggggaaaaggatgatcatgttagcaaacttcttcatggtgcaatagaagctagaagacaatgggacaatatctgtaatagattgacaaccaaccctaacctcagataaactattgtgccaaaagccagcatgaaagaaagacttctcaatatcattattacctcaacactgaatgccttagtttagaatgacgggaataataatagcagaaatacatgaaagagatagactgaaatttctttcaatctatttaacagactgaaatttctttcactttaaatagtaggaaagaaatagactgaaagtcaccaaagacaaaactagattctttgaaaaggctaataatgggcaaacttctttgaacatgactcaaaaaagtagaaaaaagttggagagatggcatagaagataaggatgcttgtacaggactggggttgggttctcagcatccatgtggtgtctcacaacagcctgttactccagttccaaaagatctgacattctttctggactccatgagtactgcatacttgtggtgcacatagatacaaggagataaaacactcagacacataaaataaaaacactttataaagacacaagttatgcaattgcagaaactgagaataaaaatggagtaaacacaaatataaagaaaagattttgaaactgtgcaataattttaataagttatgtcactaaatttgaagactacaagatgataatcccaggaaaaatgatatccaaaacaacaggtgacattaagcatccaaatagcttattaaacattaaagatttggcctgggcaatagaggctcatgcctttaatcccagcacctgggaggcagaggcaagtggctctctgtgagtgcaaggccagcctggtctacagaatgggtaccaagacagctaggactgttacacagagaaaccctgtcttgaaaaaccaaacaaaaattaaagaagtgaatgttcatctggaagccccaaaaccactgaaagattggttttctaaattctacacaaattgctccaaagacaagagggggagtcccaagttgttttatctcttggttcctgggctctcgctcccatttcttggatgttttagctcctgcctcactatgcttcattccactattttctcctaaatcctggtgtgcccaagacattagacgcccttctaatgggagccccccacaacttccattttatccattcattcactggacatcacctcttaccttcccctgtctctctttctagtactctgaattctgtaagcattctgacctatcagaaccctcatttcattcatcccactactacattacccatcatgcccagggctctcctctgctctcacttggaattcctcttgaattcctcaatatctctgtccctttccccttaatcataggctcctgaccagaccatgattgcatttaaatccaaatttccatattttttgagcctgtagaagaaaatcacagagccaggctcaccagctgactttaagggtcagatgctgtaagttgtctctctgcttattctactgtgtgctgtggaatgctgaaggttactcctccgaactgcatgctgggaagctcgaaccatccttacttccctacactctgctcagcctctgataaccactgttggactctggaagatcaacatttagcttccatatatgtcaataacaatgtgaagtatttggctgtgcctgatttatttctcttgttcaactcacttctcttaccatttccacccaatttcttttctagtattaaattcattttatttacatttttaattttactttctgtatgtgagagcgtatgcatgcatgtggaagtcagaggataacttgctggagttggtgctctccttccatcatgtaggttcggggaattgaacccaggtcatcagacttggcagcaagcaccttcacactttaagccatttggcagggccacttgctaatctttatgtcaaaattccttgaaagaaatgtctacactcttcagtgttctgttccactcattttgcctgtgaggaagatccccctcaacccctcacttcaagttccttcaaatggctccctttcaattgacttgtagctggtgtctcagcagtactgaagcataggtggtcactccctgctcctgaacacccttctttcttgacttccaggacactagaccatcttggtgccctgtccccttggctggaacatctcctttctgagttctcagagtaccaccagttctctgctctttatccttcctccatttgtaatcattgtttctgttctgtcttaggcactcatgacttcacatggctagtaatggatatgcaacaattatcaaatttccatctccagcccacacctccatctaccttgtgctccagactcacggatccaactgcctagtaggcatctctacttggttagccaacagagacctccaatttgacatgtcccaaactgagctcccagcctttccccacaaattccactctgcatttccccatcccaatagagtagcatcactctttttctcctatgttccatatcctgttcattaagaaattaaaaaaaaaaaaacatgggctggagagatggctcagaggttaagagcacctactgctcttccagaggtcatgagttcaattcccagaaaccacatggtggctcccaaccatctgttatgagatctggtgccctcttctgatgtgcagatatatatggaagcagaatgttgtatacataataaataaataaaatctaaaaaaaatagaaatttaaaaacatggccaaacccagaccttttaccactatttttatttgttgtgcttttctctaagtttctgtttatggactggaccccagcaatagcctcatgactaatctccctgtctccctttcctatctgcaaatgagatcccttattactaatatttaagtgagaatacaaaataatgtatttcattatgacatttccatacatatatgccatttactttgccagagagcctttaaagtgagtcaaggcatgctagtcctctactcaaacctccataactcacgggatagaaggctcttagcaccccctcttcagcccccgtacttcactttcccattcaagtctagtttcaacaatgatctcttccttgtccatcacttcattccatccacactaaccaagcagtgcactgggtaaccagagccatggctgtttcctctacttgtgccattacttgtgtgggtagttatccaaaggtcatctaaggctggtctttagtaaacttccaattctttatcaccaaaccctagttttatttttacctatactatggtttgaacatatatatccccctaactcattcactgaaatgtagtccacaaatgtactcacatggtatttggaggtgaggccttcaggaagggcctctagatgaagccctcaaatatcattagtggctttataaaaagaggaggagaaactcacactagcatgcttgatccatcttgccgagtgattcttttgccgtgttacaatacagcaggaagaccttcacaagatgctgagcaacaccaagttccagggcctcttagcttctagactatgaagctaagagttcactaaactcttagttgtagtgatctcaggtattataacaacacaaaacaggctaagacaattcatatgccacatatttcatccatggaaagtatgcaattcaacagttgttagtatattcactggattgtgtacccatgaacacaatcaattttagaatattttattgtttctaaaagaaacccctttgtaaacagatactcccgtttcttcttgattcccctctctccagccctgagcaaactgttcagctgttcctgtatttgacagctccacatacaggagcacagccatgtctttgacacagtgatttcaattcctttagaaatatccccagaaacgggttggttggatatcatcgtaactgacagatacggagcattttcatgtatgtgttgcccaatcgtttgtatatctttggaaaattcaggtcatttgaccatcttttagactgtgttacttgttttcttgtcattgagtactttgcatttcttgtacattttgagtatcattcccttatctgatgatttataaatatttctcatcacttgatggcttaccccttcactggtacagattttctttactattcagaagctcttcagtctgatacaactcttgcctgttttggcggtccattgcctgagagatgcaaaattttaaacattattatttaaatagaataaaaatacaaaaaaaaaatttcttaaagataacacaagtggacaggagacgaaggaagatcagaggcactggggggaggaggaggtacatattacccagcagtgtaaaaatgtaaaagaaaaagccgtaactgaattttgcttcctacagggtctaccaaaggtcagcaactcaaagcaaacaaacctccatcaaggaactagtttatccttctgggagctgtcaggcaaaatgggtgcctgttcaacaccaggtttggttataatttagaccagctcatggcaggcatgactggttagagtcccaagaagaaaataaacaggaaggaatggttggagcaccaatgtcctcaaggcctaatgccctgtaagactctagttatgtaggcagtaggtggtggccagggccaagtcctgagtgggggaactatagagtcgggaggtcagctctcccacaagcccctccatttccagcaggaagcacaattccaccactgtggctctcccaagggagaacaaacagagcaggcacaaggcaaaaggctgggttccagtgatgagtaatggagagggctgaaattatgtatcaagatgtctaactacagaaaacatgcagcacaccctgctaaatgtacaagagggagcatcaagtgacagagacaatgttgtcatcagtcttacatattcagcattaaaaacactctattggggctctgcagttaagagtacttgtcttccttgcagaggacacccaggtttgattcccaacatcccacatggtggctcaaaaccatctgtaactctaattccaggggatcctaagcattcttctgagctctgtgtgccctggcacacacatggtgcatactcatacacactgtgtgtgtgttatgcatacacacacatttaaagtacttcgtttttctcaagggtagattatttgtctaatctctgtagaacttcttgaggccctggaggacgtttttcatctcttgtcccaattttgcctctcggaacactgtatgcaagcccggagctgcaaaggacaaattgatcctttgtaaattacaattggagtggattctctgaatagactttgaccagcacgaatccacctccacacagtcctccaaccctagccctctgtcatgagctgacagccgctcctaaaaagatcaggagattcaccaggatgtgtgaactcatacagctcacagcacattttaaccctgcagttcgcctctgactcctctgacctttggtaggggttgggggaagaaacctcccttcctttctcctatcatcccaccctgtcacctccgttttcttctaaacacatgtcgggagagaaacgttcttcatttgaggcgtgctttccttggcctgagcttgctcctgtgtggggagacctgaagggagaggggtttctcgggcacctacaaaaccagtcctcctggggtaacgcacagagagaaactcagtccagagaaggtggtatgcagctctggtaaggctgggctgctcactgtgggcagtcctgaactgatgaagggaaaagagatggagttggggggagggcgggaggaggaggagggggcggccccgagcaattcaatggcgctttgatttaacaactccaagctctttgaaaacattttgccaggaaaagcttgccatcaacacgtataatctcttatcagaggcccctgaaagccagggcctcggggttaattcccccatcgcaatgagtttgaatcagctctaaacccgcagtgacatgaaagcgcccgggcctcgggccgcacagaacccactgagaaccgccggccggggaggattacggggcctgttgcacggcgggctcgcccgcaggacgggcaggctcaaaagaaaaagaataattagggataattgcttgtgtccaaacacaagcattaaggccccctgttcccctttgggactttgtgagccagaatgaaagagacaccccctgttttgacagctggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccactgcgcgaccaggcccagtgtccggtgctgcgacctgtggtggcacagggactacgggactcagaagtttcccggggctgcagatcgggctatgacactgctcaagttcacacgcccagcagcacggagtctccaccaacacccacacacgggaatataggatcccacctcgctcggcgtggggcggcctgcgccacatttggagacacccaaggcacagggtggtcccagccacatctggatgcgttcttaaagctgaggcccgcgtaggaggcttctgttcgtggctcggaagcccgagagagcattaaacacaaacagggaaccgagttagcgttcactcactacgtggggactctccaacaccaccctcagggtgctggggctgggatcaggctttcccgagagaacactgcacagccaaggccaggggaagccagcttccggcttcagaatgttctagtgcccgaggccaagacaggccctgagaggtcctccaaagaagacaagagtggggagaaatggggctggtgccagaggaaggaacctgaaagaacagtggtgtgcgaagaccaccctgagcacctggaccacccagactgcagcctggacctaaaaaggttcaagaccggcatagtacacaggcctaaagatctggaacgtggagcggaccttgcagaaagtcaaaatgcgggcagtagccaggcggctcattgtcagggtccacagccacgccaatcctaagaaacgatccaattctcccttccaaatacccaccatagtgaggctggaggatgcgtggggaagggcttcgtggacgcatggccatgagtgattaattaaagaaaaaccacatccggaaaaaaaaaaattttctgaaaggagctgagtcctagaagggctccggtccctgcggctgcagctgtggcccagacagatcagccagctgactcggagcccaccccactccagtctgcggaggggacccgcttggctttctggcttctaataaactcacggtttccgatttttccagtaaggtctgggactgggtggagaggtgactggggtgacccctgagcctgccactggctacctacgaatatcagatccctgtcattgcactggcagtattggggggtcagcacaatgtagccaaggtttgactctgtactgagctaaggcagcttgcattccccagatgagaccccatagtcaagacaaggatgtgaaattgaaaggtttagacccaggcaaatgcctcttgtcttgccttttttcacccctttagtcccacccgcgtggtttaagggggaaaaaaaaccaaggagggcaacatagtcaccaaaaatagaaagaaaatcgtattttctgaatatctcttttcattgttctaattgccagcatttattaaaatacattcagcctgttggaaattaaaatacagtatgaagtgtataattacagatggagtttttaattttctctttcttttgctttggtcctactttttacatgataggttcctggtttctttagaataataattgggaagacccgagagaagaaaaggcctgcttctaaatgaggaaacatgtagcatgtctgccacataagggggggggtgtcgcctccttccagaaagaatacagttcgggaaattatatattgcttattttcaaagtcatgggccgtttccttgtagagaaatgggtggcactaactgaaactgcacacagggacacgcttctcgggttagctcatgtttagagacaatcaatgctctatttatttgttctgggaggcaggggtggacagaagaatatcctgatgacagcaagggaccttctctcttctcctggactccactccccaccccaaccccagctgctttaatcaggcttccctaaagagagggctttggtttggggtttgggtttgttttgtttctgagatttaatactacatatatttcatcacgccacactggcttcaacaacttttaaaagccatggaattgaacatttaatttcagagtgttggccaactgttgaaaatgtaatattcatttcaagagctttggctaagagatggaattatttattatgacataatggtagtgctgtgtgtgtgtgtgtgagagagagagagagagagagagagacagagaaagagagcacattaaacagcaagaatgcccatagaatctataccaaatcagaattataacattttttgctgaaactgctgtgtgggccagttctcatgagcccaacccaaaagggacttgtgaaaatgatgtaagatgtctgaattcatgccctgcaaaaaaacccagcttggtttgccagggttactccatagatacacgccagtacactgcaccccaaatagacctgtaaccaaggcattctgggtaggagtgcacttcccaggatagatcttaggatgtgtcaaaggaggtgggttccctctaaatgcaatcattccaaaactgcagtcatttcaaaatttctaggattgtaagtgaggaatggcaaagtcaagcatcatgaattttgcgatgtattagcttggagttttaaactgttggtttgtctctttcctttggttttgtttttttaagctggggtggaggtatctcacaggctggcctggaacttgtgattcttttgcttctgcctcccaagtgctgatttcaggactgtgccaccttgccctgctcagaaaaagatatcgatttgctctgcacatagagctaggagagcactaacctgccccattggcaatttggaaacctgctagttctagaaggagtagagacctcttagcaactgaatcaaaggcactaggcttaattacaactgtctctgggagctaaggaaaggttctccccttccgaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatctataaatgaaacaaatatctatgtgtatagagatagatgcagatgtatgtgtgaaatatgtactatagttttaaatttgcattttaaaatgctgcaaaaagttttgttttttttttttatcatgactgcacatgcctaaactgaccatgtctggtatccttaaaatgctaactaaaatgcttcttgcttttcattcttttaggacctccaaggcaagagcaaacattactgcagagtgaagccactctatatgtgtaaagacgacagacataaattacatccacagtggaatgttggaaattcatttccgcctttgtggaacctgactttggggcacgggagtttcctccttttggaggggcctctaggcagagcctgggcttggcaccaaaagcattgcctggttctgtagaacactaaatctggacagatttacacagaacagaagcgttcctttccccctttgcattccagccaagcagcttggggactttcctgcgttccagctccttctgagtgtttttccaggtttgtggctaagcccaggacagagaagaccatgttacacaacacggtaatgagatctgtgtcatcttgtatttttttaagctgtgtcctgatttttttggggggggtggtggcacaggcattgtctcttaaagatgtggctgctatgacattgatgaacagtgtgtgtctgtatgataaaataaaaatcctgaaataggtttacatgtcgggaagacagattgttttctttgtagtcctctacttgaatctgtcttcacatttgttttacctttttataaacaatgtttttgtaaggacaaaagttcataaagaaggttctgggaccatttttccagacaccatatgaatgaaacaaatgtctccccatttgacaggcgtggtgctttctctaactttaaataaatgactactgcttacattggtgggaagaccactcggaaagtggctctactgtgttttcctcaaatgaaacttgagaactctctaacaggactgctccgagtatgagtggcatctaaatgtttttatagagaggtagccttttctctgctgggtcctgggcatgctggctacacagctagacctccatagtgattataatttcacatcaatacaactcagaacacaggctgtgagaaaagatacaagtcaaatacacagtcccattctgtcaaagcgaaggtcatcaatttgacaatcaagtttcttgctgaaaccattcacagctaatgaaataactgatggcatttctcccacattaattttatcatgtatttgaagcttggtgtaacctgacatgtcccaatacttctgtagtcttctcgaaagcaatagaaaagcctggaagcatggagggaaccttgatagcaaccttccccacaagccctgcctgtggagaaagagtatagcatacaatgtactcggttaaacaaatatttaacttattcctcatccaaggcaaatcagcttccagggcaacatatgggctccaattcaggggtagagcacatggttcaagtcaggaccaggagtgactgatgtatacagtcatggacaatggctgtggatggtccaggcagatttgggggtcaaggagagtggggggactgaactttgctttactctagtatgcattccagattagagctctttgccgtagccccccttactgatctagaatcagaaggtaacattttagcccaagttcctttttaacatagagctgacaaatactattgccgggtctaaggtcaaaatcctgactcgcaggacctcaccagaccacaaaggtcacttgccaagagtccacccagtcaggaagatgagttgaagaggtgaaccaagaaagaaagttattcagtatggctatactggaaagaaatggggcacatgtgtcctgaggcctgtcttcgaggagctaccaagatctttggggctatatgaagcaaagcacaaaagctgagagaataagtaaagatccatagtcaagaggttttggtcaattgtaatatggttggtcatcagctcaggtctggttctctgggcttcactggtaccaaagaaattggttcctgtcatagcgggtaagcctgcagggctcaatcttcctggaacttaagggaatccatgagggatccactgagggaatatgtcagaggagcaagcttgagcagatcaggacaaggactggatcctccatgtgggaacagggccatactgaaggcccccactactctccgctttcctgactttgagctatccatctccagtactgtgcctatgtgtgaccaacactcctcctgtgtgacaggccatgcagatggcttaagctcacagtgcagatttccttagggcctgtggtcttcaggtggctgtgagagatcttgagctctgctgttctctagtaactacttgtcacccatggctattgatgtttggctggtctagaaattcatctgtgctatgagtgtaaaatggaacttgtgtcctgttttaaactgtggaatcttctcatgtattaccataggctgggtggcttagtcacaaacatttactctcacaaacctgaggttcagaagtctaagaatagcatgccagaatacaaggacactattgtcatcttgggggccctgccactctgcctctgtctaaaattaactgcctccaaatgactcactcccaaacaccattgtattggggattagagcttcaacacgtaaactgaaatgggtgaagggaaacaatgaccataacaaaaactgtatgaaaaattataaagtatgtcaatggtgtaataatttcttgattattgagttaggtaaaatattttatctaagaggtctccattgaatataacctcttggcatttgtgccacatggaacttctctcctaaaatttccttatttatttttcaaattgcttattatttatttttataattttgagattgagtctcaaactcaccatgtagctcaggctggcttcaaacacatagcaaccctctggtctcagtctatcgagtgctgagccaccacccctggaccatatagtagttcagttttagtatagaacaaagctcatgttatagactgtcgcttccaagctcagatggtaaggagaccacagctgccatcttgggtgttatttctttcagtctaacctcatttcttctctatttcttttttatcttagatcccagtcactcaggataggatgccatgctgaaggtgccagacagagaggacattgctctggtttgccacctgaacgtttgtgtactggagtcttgagccccagtgtatcaccacaaagtcatggtgtctttaagagagataattaggtcaaggaggcattgtcctcagaagggactaatgcctgcctgtcccattggtgtggactctgtctcaagggactagattggttacagaaagggtgacaatgaagtaaacttggctgtcttggttcatcactctctgtcaccctcccaactttcctctcatttccccgacaatattgagatgcagccagtagacctttgtcagatgctaatgccctgtatctgagctattacagctgtcacattagaagacaaaaaccctcttttccttatatgtcatattgtgtctggtgttttcttgcagcaacacaaaatccactaggacaaaaaggatgagaggccatgtggaagacaaaggaggcacattagtcaacagccagcaacagtggtatgtcatgggagtgagacttcacacaagtgagggaggattttgcaaaaggactatcctacttctgtcagcactgacaaaggctgtcactaaacccacagtatgactgtagactcaggagaacctggagccaggactattcagctaagccacttgcatgctgctaaccccacaggcaaacaatgaaggctttttgttgttgttttggggttttgtggttttcttgtttgttttgttttgttttttgtttgttttttgagataggatttctctgagtagctttgtagaccaggttggcctcaaactcacagagatctgcctgcctctgcctcctgagggctgggactaaaggtgtgtgccaccaccacccagctaacaatgaaggttttatagggaagttttgaaataaattgttatagcaacaaataaggaacactatctctaaagttgattttggatcacttctgagccttttggccaaggtcaagtgtagaactgattttgcctgttaacttgtcatttttaaaaatgtggctataagaaagttttaatgtccatggctgtcccacagtgtatacctctattgggcagcactagtatccatggtttagatggtaactaagtgacccaggcttaatctgggattatagggagctggtctcaattttacaacacaatcaatcaaacaataaatcaaaatatttagctacaaatctaacaatgtatgttagaatgtgtcattggtgacaaattatacagctgtggattgacagtcaagagataccgaatttcataagtaatccacagttaggaggaaatggtacccagaaagatctctttatctcttttctttttttcagtgatggaaatggagtgcaggaccttgcacaagctagacaagtaccacaccataaaactaatccttagtcccagatgcccagcgtttctcatccagcattttttgattgattcagcacttactcactgtcgggggggggggggttatgttgttccttttgagataaacttcatgttagtgaggccccaacacaaaaatgcccccttacaaacagggataagtgcatctgagtgaagagggaacaacctgaaacccaggaattttccagcatgcccagaatggttccccacctgtcctgctgcccccccccccagcactctgttgagcactggcatggctgttcttcaacaggctgacgtctcagaactcgagagagccgtgttttcatttagtggcgtatgagctacctttgaagttgggaagaaatgaaggacttcactttctatttatttgtatttgcagaaccacagagatccaaggtgataattagaaaaatattttagaaaaccatattctattggatttttgtttttctagtacagtgacaagttctggtaagttttcagtggtgaaacagatcagatctccatcatttgatgtgagaactgctggcccaggcctcctttgctctggttatttatagattaccatgaataggctgtttcacaaaagcaaacactgtctttcattttttttcctgagatttaattcaaaagttctcttcttcatatatcttaaatgcattttagtttgacaacataattgcagatatagcccattcctcttcaaagtggggtgacttctatggcaacatttagtcaagagtagacagttcactaaaaggtcacaattgatagttttaatctttcaaaaatggctcttgataaagctgtagaaagcattccagcatggacatgtcatgtgattaacactggctaactttccctaagtgttagtacatagaagatgctctgacatttgtatcaaaaagctaactagctgatccttgatacatatctttaatcccagctcttataatgctgtggtaggcaggtctctgtgagtcttcatctacttagtgaattccaggccagtcagggctacacagtgagaccctgtctcaaaacaacaccagacatctaatctaaattaacattatttcagaaggctatatttattattttattacatgatttttttgagacagggttgctgtgtataaaaaccctggctgttttggaacttgctttgttccaggctggactggaactcacagagatccacctgcctctgcctcccaggtgctgggatcaaaggcgtgggccaccatgtcggacatatttctattgtctttagtttcaaatcctttcaaactaatattccaggtgacatcaagtcttttctatgactccagagacttggattaaaggagggtgcacgctgatctgtttcaagtggacactaccaacacacattacaatctggcttccaacccataccccactgatggctctgatatcttcctgaagccagtaacacatgtcacagtgtagaaagtgcttattaaattaatggtcaaggagtcaaaaagtagatcttcccatttttattctcattttaaaatcaatttccattgctttcccattcaatgttaaggaatatttgcttaaatcttggggagcctctcttttccctgtagcacacattagcaaacacaatgtgtatttttcttttaataaacaaagctatcagtgatgtctgccagtgaaattctgctactttctctggaaaaaaaggatttgctttataaatgttaatgcagaggaacggctctgaaatttcacaaaaagctaaacacataaatagaaaccatcattgtttgagtattcattgttttattgcatttctcttattgcttttcacctcaatactacactctcttagtggactttggatttcccattagacatggcacttagaaaaccctttggaactgaggatgtgaacttatgatgggattttacatcttctgctgctggaatccattcaatccaggtctttactccctcttcaaacctccttctgctttccacctctccttctcattggatgtccatttagtatctactctaccatacacactttaacctttcttcctcagacatcactgtccgtagctcttgcttgtaggtgacccctctaacttcaggggtctctaagaccagcagtcacttctggttgctctacttaaagccacaggattctgtcctttgcaaagatcctgccccttcctcctcagctccccaatagcttgcccattgtgtacagcctcagcaaagaaatgtgccatgagcaaagaggggaaaagagacctcctagggacttacatcagaatcaagatctgtcaccgggatgctccagacatgccacacaatccactaactccagttatacagatcattttccaattctcaacctaattcctgcctcacaaaacatgccttttcaagcaatcagcacaaagtattcctgtggctattattgtgtggttttgagctggtgatgaaggacataaagtactatcagacaaggcctcccctgggcaatttgcctgagtccctgtgtgggtgcagagccctctctttgtttgccattcagtacaagactcctgtggatgactgacaagggcagacttggaacaacattacttcgggaggataatgaccagccatcataaattcctttcttaaatagtttattgcaggttgtagactattgacaatgactttgttttatagcatgaaggaagatgtccttgctgctgtcagtctctaaaacaacattaagagtttttagtacccccagagaaaacagcttttcattaaatgaatcataaatagtgttaaagccatagttacataggccagggaagagaagaagaggaaaagaaatagctgtctcggatgcaaagaggtcctcctggtgcctctttcaagtaaataaaatagtaaggaagcttccagggctgtccttctgtgcctgtcttccctgggcaataaatgaaatcggatgtaaaaaactgtgagagacatcataccaccacacagagaaacaaaaaaggagatagaaatgaggaagatgggaagctattttgttaatccttgtgttcggaccctgtcatctcattaccaattctttttctgtgagagacattaatatctccaacaaaaatctcatgttataaataatgtttatatattgagctttaaataggaaacaacaggttgtcgccatcatcatttgagatccggtgtgactcaactgttactgaaaatgcctgccaggaagtagaaaataattctgtgagtgttttgttagaggagacagttcagatgagtgcgcacatctttattcccccctttcctttaaaaatcttttgtctttctttggaaaaatacattaagccctaagatatcttttttaaggcaagttttacaaagcacacacagagtttgagccacacaagtcatatacatatgtgagtaatcatatttttgatatatctctctgcctaatcattaactttaaatgccaaataagaatttgtaatctaccataaattatttcacaggagtaatttaagagagctgctgaccaatgtgaaacatgccagtccacaagcaattggccgccaaacattggagggggaaaaggtcccagataaaaattaccataaattacaatgactgtaagtctctaacgatcaagtggtggttagagattattgcatttagaagataggaacaaacctattaagcgtcatgacatccatccagagtccattttactcatcaggaagctggatctttcaaaatccccttgaacatcctcacctctcctcacctcacctcacaggatcacatctaaagtgcatcatactagttacagtccattgaacgtagaaaacaggcaggaaatcatttttgaattatgatggactacccaagctctacttttataatgaaaacttcaaaataaaccctcaatttggacttcttgttttctcccttccacatataaaaagcagctgcatgtgagtgaatcaggcagaatggttgacagagtcaaaaaccagaaagggatgcacagccccataagcagcgactatgctcaggtgggaattcacaatgggctgaatttgctatggttattattgtgctcaaagaatccctatgaagtgcaggggaagttataaatctgtttgagaaaattaattcctttttcaaatcttcatcttttccttcaagatgtgtctccaaagaaagacaattacgtcaaagaaggttcgggggcctcattctgcacactgccttttaaacacattctggaggcctattaaacatcatgtaaactgtagacagcaatgcttccaccaccccagcccttcacatctgcacaccagcttcttgggagcagaacggagacatgtacattttagcatatttcaacaacagagtcttgggggctgggaggtgtgtacctttctccatatatggccatcatgaattctacccaagaactcaatacagattatttatataatattcccactcctcacccccacctccaggctggcagagggtgaaggaaacattttgggaaagtctctaccacaactgtcttccaaaatatggatggtgctaattggttctgattttcttttttaccagcacatggggtatgcagggtatttttaaaattaatctttctaaaaaatatcaatgtatacaacaagttgaagttatttacacactaaatttatttatgattgaggactctttaatgaatttactaatttctttggaaaatcccagtatccactcaaattccaggcatagaaaggaagccccatagaataaagtagattctggatggtatttcataaatgacttggggacaatgcccaacatgctcaaactatgccttgatgattaaggagggcaaatgtagtcaataggtagggagacagaatggaaatagattccaaaggaaagataatgtttatatggcaataattatgtttttttcaagagtagaatctgcataattaaacaagaataagggaggtcgttttggtgtagtggccatttaaagaacatattgcaaggacgaaaatgtagtcagaaaagaagctatagtgtgttataaaatattatggcacagggaggaaagggtcattaggcctagatgccacttctgctctattcttagcttctgatctctccatcagaactccactcctacctcatagacactgtgaagatagagcaaagaatagtttaaaatggctctggaaactgttaaccaacatagcaacacagaacccagttaccagcacatacttattgttgtctgtttgtttgcttgttttttgagacagagtttctcatgtaattgccctggctgtcctggcactcggctgtagaccaggctggcctcgaactcacagagttcgtgcctctgcttaccgagtgctgggagtagaggcatgcaccaacacattcttaagcatggtacagagacctggtgggagccctacgttgacagtgcagtgaaaatggtgttgatcctgcactgcgggaacgtagggctcccaccggggctctgtactcaagccctgtctgtctccacaggagcctctgtgtccagaatggtctcaagacagagtaggtgttgctctatgaatcaacctctgcctgttggcttccaatataagatgaaaacaaggcttttctggatacctccagaatcagaatattcccttggagatcagagaagccgcagatcattggtgttgcagggccaacccacctcctacttgggtcattttctcctgcaaaacatactatacttcacccattggtgttgttgtagctctgccccccaggggaggtgagatgctaaagtgttaataattatctggagcagaacatttaacaatctggatctcaggatggaatttaagcctatttagatttactgtgaattctttgaggttaatgcaacttctgaatgtgactagtaatctctaattatttgcggagatggtagatgtgagaccagattaaatccacagataatccccaaatctcattttagccaacagcgaagctcttttcccaccaaccccaaccccagaagaatcaactgaaaaacggcaaggttgacttggtgctcagcttttctttctctgcctaccctctgctagtgcaaaagagtcgcagaattcccaacgggtggagggtggagagagaaagccagcattaataaccggagagtggaaaatcgcagcctgtgccacactgcgctgctggaggagcaggcactgagtaacagaaacgccagaatcctggcataaaaggaacaaaccacaaacacagaccttaggagccctgagaggcagtgtcgtcaaggagtctcactgtccctgctttagacttaggtaccctgagatcattactctcagccccgttgagctagcttcctccagacagggatgggagggagtggaacctggagccgccacttcaggcttctagctccagacaagcccaaccccggctttgagtgatccctctcactaagacacaacatcttatagctaggcccagaggaggaaggcaaggcctttggaaggcaaggctgatgaccccacaacccttgttttcatgttgtctcctcttaaggcttttaaaatctttttcttactcgattgtttattagcatcagaccagtttcatagtctcttcgagccaggtctattttgaaaagacattaatcttacttgaaattccaaaataattatattcagagaggcaaagctttccaaatatcttaaggcggagagtcccgcttccttaaaaggaaaaaaaaaaaaaaacctgcaaaatattttattaaagaattaaatgtccattcgaatgtccacacgatacacaaaggtctcgctgaattctgatcggtatgctttttatttatgttgagcctgccagaccagaacctttggttagctcatgttccaaagctttagaacgcattcgaatcctatagaagaaaaatggagacagtgtggcaaagagaggagaaccggatgaacgggtttttcttggggtggagtgacagagatgtggaaattggtaccaagagctgaaaggagccagcgtggtgggggagggcatcaaatgcattatcaaaagctgactcctgagcttggattctgagccaccagtctcgcggacagggagactcccagatagaggcatgataggcaggagctgggcacctttcttcccagggtaaaatgtcggtctgagggatggagggaccttcctcccggctcagagctataagctccctagcggccacttgcaggaccccggcgtagagtcaccgcaccagcagagctggggagcccaggccagtctcagggtagctggcataggtctagtgacgatcctcgggggactccgggggccaccctccgcctcctggccaccggctccgagccctgctctgcgcccgcgcgccaccacaactggatagacccgcaacctcgggcctctttcctgcccccgcgtggccatccagagaaaacctcgtggctcttgcctgtcacctaaggccactgctactgctgctgccatcccgatgagggacacctaggtcagtgcggaggcgggagtggacaacgtgcaggggaaaaaagaagaactgtcgaggggagtggcgctttttctgagggaccgagaccccgtgggctttgacaggaggatggtcctacatagctggccgtctaaggttgttgaccaggaccaagctagcggtttggacaatcacgtgattactgtgggaggacagtggaggtgcaatacggaggtaggagactgaaatgtcctacagtgggcatagcttcgacccaggtgagccagcctggctgtcctttggcagcttgcagagccttacaaatgactctcatatctggttgcatgtgggtacgtggcttttcctttggccacatcagccctctgggtttcagttgccaaaaactgtgtttactatcctctgtttgtcatacaaggacaaatccaatgtgtctgaagagggttggcttcctgtctttgctgccgcctgaggaataatgcttggggaacaaatatcagatggagacccattccctgcggccatccaggtttctgctggctcaagatcctgagtcaggtaaaaagattggcagtattcaaagctgtgctaatgaactcaactctctagaaatcactggttggttgttgaacaaggtctgtgttttatggaagttctctagagggctttggactatttgttttcaaatctgtttctcagtttccagttcctgaagaaatcctcttcccccagtgagaacaggggaagtcggtttttgttttgttttgttttttgaggatcttagaacaagagtagttggatttatctgtcacttgccagtcctgagacatctattttctatgtggttggctgaaaaccttgagtgagataagggaagttgaacccttggacttgattctggtcccacacttatccctgggtcccagggtcaggatttgcattccaagtctgtttgatttgtcaggtgaactagtcactgatgctcatgtatagatgttgttaaatgccgattctggggacatcttgatgcttgtgtaaggattgccgctcgccagaagttggtgctaattgatgccaggcagttctgcagccaagacttcaggctttcgtgtgttgtgctcttcctataaaggggaaatggttagccaaggcctatggtgagccaggaggaacttcatgttacccaaaaagctaaacaggattgtgattgtccttggacctgtgaggaaagacggcacttggattgattgtccgttttgatgcctaacaggagagtgtttccctttacacaatgccactaaaattgtcatttcccccttccacacagtgtgttgaggttattaggagccccctagggaacagccacttcttgtgtcctgatatatcacattttcatgatttacctccctagagtcttgagccataaaaggttctttggttctccagctgggccttcccaagcaaggataagcaccccattaccctttccttatttaaagttttactaaaacaacaacatccgtgaaaacaaaaagtaaaacaaacaaaaaattaaaataaacaaaagaaagccatctggtgtgtttacaaagcatacatttcttactctaaaataattaaagcctgccaaagattgggctggtcctgcctctggcttacgtgcctgctccatgtcacagctgggaagaagaggattcaccactggactctctagtcctcattggggaggttcctgctaggatagacttcagtttccgtgtgtctctcattccacggcctctgagctacagagagaaggctttgccatcaggccttctgggttccttcctaggtctcttgggcagtcccatgctgtcccccagcagtatccaggaaggttcacagccttacctgttactctgttctcctgcagcaagactaagagtctgggtcccctcctcccagaagcctgccccctcagtatttacccctccctttttcttccctcctgccctccaccacactgctgagaaccacctgttttgtgttgtgaaagcagccccatcctcccctcacagacctcccactgagttccaatttccagtccaaactccacatctgagttcttgactcactggaaaagtataaaaacatcgcagattcggaactgactttcatactggagtcttttcttccagtttgctcctgtctcagaggagtagtctcagataagttctaaacctaagggtggtccccggactcctccaaaatcatggtcatctctgcaggttgccatatggcccataaaccctctcgaatgtcctaagtatgattttacaatcgaaaaccatgactttgttgtgtcaagaactgtataatcacagcctcaagaaaacaggttcacattctcatctgcgtgacaggaaggaccaaattccccgactggcagtttgtgactctcctggtgaagtttatttattgaatattttctttagccttctaccaacatctgttactaggcaagtaggagtgagtgtcaaaggttgggggaaattttttttggaagagtaaagcctttaagttcactacagtctcagataaagtagacaaaacaatggcctcccctgaaggtccactttctaataatggagacgggcgctgttacctttcctggcaaagaaggcttgcagctgtgactatgtcaagggtcttgaaatggggacatttttctgaatgatctgtatagaccccatgtaatcacaagggcctttgtaagtactggagggaggcaggagagtgacagacagaaagatttgaagatgccaaattgctggctttgatgatgaagggcgaggctgtgggccaaggaatgcaggaagcttctaagaagctggaaaagtaaaaaagatggattctccccaagagcctccagcaggaacaggccttgccaacatctcgatttgaatccagcgagacccatttcagactcctgacctccagcactgtgtgctaataaatctgcattactttaagccactgaaggtgtcgttgccttccacagtaagatgtcacagtgtccgctagcttgttgacacacttgagaaaagtacctttcttgttttgaacttgaagggacactggtacagcatggagaataaagctgtgcccccatttattccatcatcccaagttttgccatttgccgactcataactgacatcatcaagaactgtttgagtgaggtactgtgataaactttatatggaggggaaaactgaggcacacaatgtaactaacgtccctgaagctgtgcctcagatccaaacacattctcctcagcgaattccaacattcttctgtgtggtggaactctaccctcctctcagagaacagctcaaatacccagcagcatccccgtacaccccaggaacagtggctcccagtctgacggcctcctttcccggggagtcctccttggaggcagccagcctactgctgcttatagaactgctttaggctgcagtaaggtttctgttgaaagtttctaggccagtggcacattgggaaattattggcaaattggacttctgctcacctaatgcaaaggtctgtgtgtcagttgatagttatccttcacttcaaaggccagggtagggaaacctcagtttgccctgacatggcagaagtccttgtgtttcttcctggaactgccacttccaagggaaatgaatgccctgattcagtgagtgtcagccctggccacccattgcaatcaccacaaaagcttgaggcatcagtcagttgccaggttctaccccaaccaatgaagtctggtgtggcctggacatccagacctgttcagtctccccaagaggtaggtacctactgtggggtgaacaaatgcactgacctagtagtcatagaattggaaaatagtgctagtccccagtgctcctctgaggagagtctgtagaggtgagctttggggtttgggagcacaaaaatcatgaactgttttagtggggaacagcaaaacacacgtctgtggaggtaagcacttgtggttgggggaaggtaccctggtatcagaggtaagagctccgtgtgtgtgtgtgtgtgtgtgtgtgtgtgtgtgtgtgtgtgtgtgtgtgtgagtgtgtgtgtgtgtatccttgagtatgcatgaggctatgcctgcagtggatatgtggggtatgtgtttgtgtgtgtgtgcatgtgtgtatgagagagagagagagagagagagagagagagagagagagagagagaacacctgacaattttgccagcctacaatctccccactgcaatggcctcaaagtccctgtggcctgtgtcacctgggttgacactgaggcatgctggggagcagtccacagaaagtttaccctgctgctcactgagcttcggtagaaattgtacatttatttttctcagtgacagtataattagcttcctctcttgtaagaaatgaaaggcagggcgctgctgacagctgtgggagctgccttcctgcccggatgaatcgagcctccaccaatgctgttacacctgtttaaacaaggaacagaataggtatttatttaaagttcaagaggccatgtgagccacggcctaaatctaggcctggatataattatgaagatacttcatcctttgttctaaaaggttttgcagcccgtggcccctcaaagtcttcagagtaggtacctcccagagcgagaaaaacgtgtgagcatgactgttgaagtggaggtagcagacctgtgatctcacaaggacaccagaatgatgacacccaggccttgctgatcgctggaaccatccatgcggacatgtgataaaggtgccaagaaccagccacctctcctagcaatagtcttgtacttgaaactgggcccaagaatctgcacgcgtgagtgcctgcgctcgcacacacacacacacaaaccttctcttgggctatcaagatggttcagagagtagaggggtttgccgccaaatctaacaccctgagttaaatcccagggacccacgtgtgggaacgagagaactggctacttaacagcaagttgtcttttgatcctcacacacaggctctagcaacagtgccccaccacccccgcccagtaagtaaataagttaaaagaagtcccccagaagagttctaacaatgactccagttttgatccccctgacctaggacctgggccaggagtggaagtgtttctgagaccagggcagggacactaaagcagtaattagcatttactgaacatgcacacaagcaagtaccactcattaagccactaggcacaagcaacaattgggctctttcgttcattcatctgtcatactctgggggacctcagggcaggagttctctgtgtttttgaggtcataggctcatttgagatgaaagaaatctttattaaaccctcttacctgaaaattgcatgtgacagaaatttcccacaatttcagagggtttgtagagctccttaagccctcttaatggcttcagatggagaatgtccatcctggaggacagtcccttgtggtgtccatgcacaacagcctggattggagcttttgagcacttcctgtatgcagaacacatgagaatgtctgcaggcacaaaagggaaagatgaggcaagatagttggaaagaactgacagatgaggaagacgatataaagttcaagggcatttatgtagagatcttaagaacaggaattggcaatgtgctcaggtgccatggactgtggccctagtaggagaactgaaactggggggagccaggctgtgcctgagctcagcacaacagagaggattatgggtaaggagctcagcaaacaacctcttaaagaatatggtacttcgtggagaagaagtaaggcatattcaaagatgagagagagagagagagagagagagagagagagagagagagagcgagagagagagagagcgagagagagagagagagagagagagacagagagacagagagacagagacagagacagagacagaaagacagacagagacagaaagacagacagagacagagacagagacagagtcagagacagtgacagtgacagagacagagaaatagaaggaagaaatatgtgctggttggtttttgtcaccttgacacaaacctagacatatctaggaagagagtatcttaattgagaaagtggtcccataggatcagcctgtaggcaagtttgtagagcattttcttgattcatgattgatgtgagaaggtccagctctatgtgagtagggtcacctcttggctggtggtcttgggttctataagaaagtatgaaaaacagctcctgcctccagattccctccctccctgtttgagctcctgtcctgacttcctcggatgatggactgtgatggactaaataaaacctttccttccaaggttgccttgggacgtgatcttcatcacagcaatagaaccttagtcatgataaaaggtaagggactgagaagatgactcagttgacaaagtgcttcttatacaagacctgagtacttattgtacaggcttgaagactttagtttgtctctggtgtgcacataaaagctaggtgtggcagtgtgggcctgcttacccagcactgaagacactagagacagtctagtggaatcaataagctccaggttcagtgagaccctatctcaaaataatgtggagaactgttggaggaaatatcctatgtagactattgacctacacacacacacacacacacacacacacacacacacacacacacacacacacacatagcatactaatttccagttctgacaggacttaacaaagtggcatgtaacacacttgtccattctcttgtttgcaaatgacaccagaagtctaaacttgcaactatttgtgaaggtgggatttggggcaaacagttctgcacccttctgtttctttgccttatcatatacccaccatacagtggctgtaagtctgcacaggaatttgtgggtctaggtccctcttaagagggaccctaagaattcctccctctatcctgtagggggagcagctgcagttttgaggtctgtctttgagttcttccagggtggagggcagggaataaactctatgctgggagactagccagaaaagaactgtagaggaccagatgcaagtaggtgcttgccaagggccaagggacagcagaccctggtgaaggtctatccagacctaggagccagagagaggaggggtgtgcaagaccatagctttgttggagagtggctgagccaatatgatatagagggtctcacggcacagaaggcactaggcatggtgaatctgcatagtattgaagactaatgccatgaggcggcccactgcccagttggcactgccactctctaagaggtattggattctgagatgtgtctgctcctttgctatgaccaggacctggcactgtgatgtgatgcttgggttactgaaataggcaaggagtttcagcgactcgaggcaagggtccttgcagatacatgaagtgtttcagtaatgggtaacatatgaaagtcaacttagaaaaaaatgtgaacttgtaatggtagatgttggcagaaataggagaaagagctacctagaacggccctggactttttgggactcacaggaactgccacaggaaggcagtgatgaggaagtgtggaatcagatgtaagggtctcctactagtctgggccattagggcatggtcagaactgtgtatcagcactgcctgggagagaaaaagtgatttcttagacaaagagtagtttccttgttcagaatgcaatttctttgcatatcaatgagctgactaaacaaatccagaaattattacaaggtcctagagcccttttaaaacaatggagaacacaccacaaatatgatttcctgtttagatgaagccacacatgaccatgtttcaagagcagcagcaatgtaagttcacttagctctgttcccattcaaaatgacactgctgttttcattcatgaaactctattccaggatttcattctctgctttacacgaatgtcccttagtgcccaaagggatgaggagtttaaattatatgcctttgtattcactggtgaaaagaacccaattccatcctgtctcctctaaattaattagaacacagatggtcccccattctctgtccttgtcacttctgcttggaaatgagagatgtgccctttctggcaccatcctaagtgccatacagtcacgagtcacctaacgacagggatggggatcattctgagatgtatcattaggtgatctcatgactctgcaaacatcatggggtgcacttatataacctaggaggcacaggtcagtcatgagacaagggctcctgatgcaatcaagatgtggtaatcacgaggtgcgtgaagcttctgttaggatagcaaggcttactgctttacagtccactttttaaaatataagtaggactacagattagcaacttaaggtgtagtgcggtggctgggtgtggtggcacacactcctaagcctagaatggtgtgggggtgacagcaaggaagaatttaaggtcatcctctgataaatggaaagttcgaagggctgcatcaacctctgtagcaaactatagcagtgtggccaggaatgggcttgatagcccaggaggatctctgtgagttcgaggccagcctggtctacaaaacaagttccaggacagccaggactgttacacagagcaaccctgtctcaaaaaacaaaaaagaaaaataactttgaggtaacaatattaaactatttagagatgaagaaaccgaggcaggtgcataataaagtcattgagtcagtacatgaccgaaccaaaggcagagtccagagccttcattttgaccactcttgttttgtcattcatgtaaattggtgaaaaaagaaaactagactctgcccccattgcccccagatgaactaagaattgacagagcctttggtatttctcttctgttgaaagcttgcttgtaaatgagacaagaggtaggatctgctgtcactaccataattgccacactaagcatttgaaatggtgtccattgctctgaaaccaagacatgctctcaagtccgtggcactcaggggcacttaaggacacataggggcacttaggagcattgagctgtgagaaacgcaacttcttagaactaacacaggtcctaaagtcaacagattttctttctggtttatgggagcttttgaagaaaggtgtacaggtggcaatcacatcaaggcacaggtaacatctccactggatctccatctcagaaagaggtcaatggtgttttaattatctttccttctgatgtccaactctgtatccaacataggaatagttgatcaacagaggaatagaacagccagtccagaacaaggaagtcaagatgaagcttccagaactaaaggtaacaagaacctcttaaagcccagggtctaggttgacaagagagatttatttaggttccttcctgtagcaagcatgctaaccaatatcttcagcacctctcctttctgggcatgacaataccttctgctttccagaatccttataggcagacacaagcgtgtgactggttatgttcaataaaatgttagtagagacggtgcacattaccaatgagccgagggagtgggtacccagctctcctcctcggatgcagctcccatagaggcctcagactgaggatgtgggagtcactagatgagtgtgacttgaagcactatctgaaggacagatgcttgagagtcacctgaatgtgcaaaggacttcatatgaatgaaaaaataagcaaaacatatgttgtgttgaaacacagagattgaagtggtagtggttgttactgcagcaaaagctagaccacgctgactaataggcatagctgcctaagttttctaggtttcttttgctaggtcaggtaatttaccatcccctaaaagtttgtcaatacaggtgacttttttcttctggagctaagaggtatgtggatctatgacaccatgtagatgtggagtattgtttaacacagctattctgctcttcctctgtttcctttgtaacaaaaaaatgcaaaacaagaccaccatccccagacataaacactccagctcccactacccaggagtcacaatcgttaagatgtcacagtttggttgcttaagatcaccttttgcttgttttgtttattcctctttttcgttttgttttgagacagtgctggcaggaactcactatgtagacctggttagccttgaacttgctgttatttttgcctcctcggtgctgggtttacagcataagccagagcctcctttttagaaattaaataaaaactgttatggtctcaattgaagtactccccatacgtccccgacctgtcccgtactgtcagtgtctcataagggactgccttgtgctctggggtaatgggatggggatgtgggcacacccatcaagtcaagtcctctttatgctcttacctacacacacacatgtgctaagactcatgtttatacgtgaggaattcttggacttagttattgttgacgcagtgttaaatgccaaagtttgcctcggtgataagtgtgtgtgcacatgtttcagttttgctctgtttagcccattccatgaatgtgacacatttaccatctctttccctgcagagggtgccattgcctccagttctcatccttgggctcggtgctataggccacaccttccagacacctattcaaagagctgctctagggagacaaacaggaacaatagaaacggagttgttggggcataaggaatgtgaatttttgtttttccttgatgctatcacatgtttcttttttattaaatttttattttgagataataattacattatttctcccttccctttcctccctctaaatcctcccatattcctctgttatacagttcttgaggagacagattagtgtttaccaaggaaaactatgtttaatactcatatcttgatcccatggccaagttaatgtatttcacacatggaaagcttcccagctgactacacttgtaccggatgattgtgttttacacctttaagcattaaggttttgtttttgtttttttcaaaagacatattcatcataaaacaatgcccaaaggaacaaagaactgggaatcacttaatccaaacataaacacctaccaaacattcctgatggaagcagctgtgtgttcgtgtttcatatccagagttgggctatgcctctctcgcagcatatgttaggaacatgtgacagttatctaagactgtaatagctctgtttgctttggaatggagtttcttctaggttcacagctgaggggaagggaataaagaagaggggattaatagaaggatgtgctgtgtgctggatctgatctgatctttgccatccagggacacaagggcaaccatgctttaccacagagggccatggagttggaactcaagaaagtctctggttcttctacatgacttatttcccttccacactgcctgccttccactgggatggtatccctgcctccatcttccatcaaatccaaagaccctagaaggtttgaagatgcaggaggcatgtaaaaccttggtggatccaacagaagcaagatcttttgaggttgacatccaccttcccatctcccatctcaggaaacctagcagcagagtcttcttgaaggccctgtctggggtggggcagataacagtagaaggatgaagatgaagggacatgccttgatggaaagaagctgccagatcctgaggaagggttctgagctctcccacatctgaagaggggatagagagtcaggggacatggaaaggtaaagctgaggtgccagcattgggtgctaaccctgcattccatgtaggaaaagaacggaaagcctgaattcaagagctaaactttctctattgcaacaattccctccctccacaacatcagcatcaatccctcctgacggtcacgccccagtgacctaggtcccacactgtaaaggttctacaactacgtggggacaaagcctctgaatacaaatctttgaggaacaaaccacgtgcaaaccatgacagtcaccaagccagggacacaaatcaccacatacccagcaggcttccaggatggtgaggagagagtgccctaatgttttttcaggctaaattgtcttttatgtgtatgagtgttttgcctacatgtatgtatgtgtgccatctgcattcatagtgaccaaggaggtcagaagagggtgttggatctcctgaattggagttatagatgattgtgagatgccctgtggctgctaggaaccaaacctgggtcctttatatgaacaagttttcctaaccactgaaccatctctccagctccaggctgacctttcaaaactatcttattacattttactgatttataatttcttgtacatgttgtggtcacactcattccatcctacaataattttgtttgtttggttttggtttttttcaagacagggtttctctgtgtagccttggctgtcctggaactcattctgtagatcaggctggccttgaactcagggatcctcaagtctgggtactgggattagaggcatgtgccaacactgcctggcctacaatgatattttttaatatttatttattgggagaagggtgcacacatgacatagcattgagccatctcaccagcactaggctaaatttcattctgtagatataaagcagtttggcatttcttgaacttgattgtgtggttcagaatgtggaactgactacatgggcagcagacccacatcatcacactcagaagagcctctggaagccaggtgttggtggcacacgcctttaatcccagcactcaggaggcagaggcaggcagatatcggggagttcgaggccagcctggtctccagagcgagtgccaggataggctccaaagctacacagagaaaccctgtctcgaaaaaccaaaaaaaaaaaaaaaaaaaaagagcctctcactcagctccactgaagcacttcattggttctgaacaggcaatctgtatttgtacttgtgtggacgcgctaaccaccaagtcaacaacattcgtgtgtgtgtgtgtgtgtgtgtgtgtgtgtgtgtgtgtttggagggggaggttcgagacagggtttctctgtggttttggaggttgtcctggaactagctcttgtagaccaggctggtctcgaactcacagagatccacctgcctctgcctcctgagtgctgggattaaaggcatgcaccatcactgcccagcctgcagcactcttcataaaccagcctaactaatcttcatcagccacctctgggtgtgtgtgtgtagtgtcatctccaaaggacttcactaaggaggaaaaacacactgtgaatgtggacagcatcatcccaagccagcatccaggaatggacaaaaaccagaaagtgaactgagtgccagcatccttctctgcttcctgactgcagacaatatgaccagctgcctcatacacctgccaccaaacctcccccaccacggtaggctatgttttttctttctattttatttgtgtgcggggagagcacaagccatggtataggacttgaggtcagagaacaacttgtaggaatcaatttcttcttccaccacgtgggattaaactcaggtccttaggcttggctgcaagcatcattactagtcagtaaagatgagccatcctgctgcccttcctactctcttttccaacctaaaccaaaatgaacccttcacttctaatattgatttggtcaggtattttgatatagcaacaaaaaatatgactgaggcactgttctacttgcaaaaagcttaaccacccagagaaatgatatccatatatatgcatatatcttttccacaaagccaaatataaacaacatgtgttataaaattaagtttgaagaatgtggtcatttgaatgaaaattgttcccccataggctcaggtgtttgaacacctgattcccagttgtgacattagtgtaggaaagtgatagcttttctggcagagatatgtcactgggttagggctgggagctttgagagtttatagtctcaccccactttctgtttcctttctgtgcttagtgtttatggttgagatgtgagctctcagcttctgctcctgccaccttgcctgccccttgcagctatgctatcccaacaagatgcattcttatggctcttataaactcaaataagctccttttcccataagtcacttttggtcatggtgttttctcacagcaacatcaagtgtccaatacaaagaagtagcatggtggtgcatagtgagagcagcctaggtggaaacaaggctgctcctggggtcccttttccatataactaggactctaaagacaccagggaactctgagaagtaaggaagtgttacagcatgcttgacctccttctagcagtagtcctcacccaacaggatggtgtcggggtgcttccccaggagagccagcgcaatatcgttctatggtccttcatttgcacgtatctgtagaagtcaccagtcagtctgaagtctttgtatatatttggagctgaattattccctagtaaaggtccagatgcttgtgatgtctctgcagtttgttcccaggctcttatacagatcgggtatactttttcccacatttcgatgtttgcactgctgcactacgaggtctctgaaggtactatgcaggctgagtgcacctgagggttggctctgaatgcacccaggcatgaggggttatcaggtggaggtgacaccaggaagcaagaggctggggcattcctcccttctacatcatcacggctatgccctccaacactcattttcctccaccacacataactctagtcttctttctctgtagtgaatatagaggagccacccatcgctcaccaaatcacactcaagctgctgtcttggctgtcttattgacagtcagcaactagaactattagatgctttcctgtgctttctaatagctctgcagtgagcattcattcctacaacacttccttgagagcagtggtcttcaaccttcctaatgctgtggccctttaatagagctcctcgtgttgtggtgaccccgaaccataatattattttcgttgctacttcacaattgtaattttgctactgctatatatcataaagtacatatctgatatgcaggatttctgatatgtgacccctgtgaaagggtcatccaaccccaaagggatcatgacccccaggttaagacctactgctttaaaggataaagaataaaggttgcccagagactcttcaatgtgaatgatactctgtgtatgaaagatagctgacactgagttcagatttctacagtcattaaagaaataatgatctccatgagatttcaatagttccaagcacatatgacaagcatgtgtcctgtagtttgaatgcatctccccactgtttgttggcgagtcaaatggaaatacagtatagttcgtacctcacaggctttatctagaagtcaagggtcagaaagcacctgccacagtgagagctcatcaagtgtcaattatcgttgtgcgctctccgtttcctcccctcctcctctcctgcctttcctcctctccctcctccccttctcttcattgttcttttctttctctcctacttcttctcctctctttctctccatctccctgtgatcctcttccttccttcctttccctcctgttcattgttttcaaccatctattctgcaccatggatgttgaggacaaactagcacttctcaggcttactgatgacctcgttaaaattcagacactcactcagaaggcctggggtggaggctgagattctaaattcccacaagctcttggtgatgcttgctgcaagccagtgggacacacttggtgatgttgagtaccatggtgacttgatgtccttttcgaatttccaggaacaaaacaccttgagtatgttcaagcgaagtaacttttcttctggactctttgggtagtgtgatgttgccctgtctctcaggaaacacaatctcttacttcagtgtaaggctctctgctgcttctctgaaatcaaggcatttttcacagcatggggtctctagctttacagagtttatatttaacatgttaacattcaagtacagcctacacaaagccagacctgggtgttaaatgaggacttcagacaacagagagcaagactccagcgtctgtacagaactgaggcccaaacaccggctttgaaatgttgaggatgaacatatgctccacatgccgggcagcattcatatgtcttaatgcgaccagtcctgtgtctctccatagaaatacacactcccacaggacatgggatgttgtggcgtatcgtcaagtgttcatagctacaagttttcctcattccccattactggagcaacctctagactgtgatgtggacccatctggaacatgcacacacaggctgctggctgctctgcaccattgtacccattgtttaagcaacatgtttatctcatctggctgcattttgtgggattgcagcccctgctctattacatctgaagattattatttgctatggaaacactgatgtcaaatggatgtgggtggggctcaggccatgaataaacacaaaatagttcatcccacagggtgcaagttattattgggtctaggaggtgccagctgtgtgggtcacccctcacaagctccatgttttggatggcacagtctggaaggcttcagggtatctcacttaagagaaaatgcatgtttaagaagcaggaacaccttgggatgagtgtattgtcccaaataggacacaatttccctgtggtaacatagaaacagagcagagaggtaacttgaaatgattttaggaaaacaaaaacttgtgttagcttgcttttgcatatataaatgtgaggtatgtgtgcatgtgtatatgtgtgttcatatgtgtggggggagtatacatgcaagcacacttgtatacctgtgtgtatatgtgtgtaggcccacagttaacactggctgtcttcctccatcattctccatcttgttgaaattgaagcttgctgttttagactactctggttagccagcctgctctggggattcctgtctcacatctcacaaggtaaaattataggcaggcccccatgccctcctagcatgtagttctagagatatgagtgctagtcctgtcctcacatgtaaacagcaaactctacccactgaaccatatccacacccctgaccctaacagttgttcactcactgtgtgtggtgagagaagtgatcaaatgttacaatcatccttgtagttaaatagggctgaagtcagccatatctactatgggaagccaatggagctaggagagtgtgttgtggaatattaataaagatgtattacattcttttatgctgtgaatatttgtttaatggtgcaaagaagtgttgcattcaaatatgctgcatttgttaaactctgtgaagctgtgttgctttgcctgtctaaaacacctgattggcctaataaagagctcaacagccaatagcaagacaggagaaaggatcgatgggacttccaggtgagagaataaatagagaagagcaagaagagaaggagcaagagaagaagaggagatgaggacgccaggggccagccacccaacaacataatcagccacagagtaaaaaggaaagaaaaagatacagaacagagaaaggtaaaagcccagaggcaaatggtagatgtgctaattagttcataaagcctttcaagttctaggacccgagtttggtccccagaacacgggcaaaaatgccacaggttcacacttgaggcaatctcagtactcaggaggcagagacagggagctctttgagactcactggccagctagccagcctacttggtgagtctgaaaccagtgagaaaccctgtctcaagaaataaatatgaaatctttgtgaagataagaaaaggaatgatacccaaggttgccctctggcctctacatgtccatgcaccacgcacaagtatacatgcccccaaaacacacacacacacacacacacacacacacacacacacacacacacacacacacagtgaagctaagggattgggaggagtttcagagtagggaaatttgaaatcatgcaagcctcagaactcaaatcaagtgtacagtgcttaagtctttcagccctggtcacaggatactgcttgagtcccagcctctaggtttcattttaatttattttctttctagaaggcattgctttttcctactatcctcttgccaactctttgcttctccactgcccctcccccaagtcaggactacacagctgagcagcagaacacatacatcaaagtccttctgaacccgacaatcagctcttctagctgcaggtaggaatacttagggggaccttaaacattattgatgttacaaatagtcaaattttatggctctaagctgcactccggttggagaattttaaagctgactagattattctaacattcagccacagccgagaatcatggagtcaaacaatgtcatgagtggccctcagaggggacatgtgctacacaactatccatgctgtgagtgacacacccttgagacatgtggcacgtgacccttcatgctgtctttgcccacccctctggaccctgcacgatccccaataactcaagagatcacaggctaaatgcatgatctggcctcgatttccccccccttgggttggagctggggttgaagatagtatagatctgaagccccccatccttgcaggatcctctgcttcctgctgccttctgacaagggaggggtgagtgagggttggaggcttctgaaaactcaggaatcttttcaagccccattttggaggctgcccagttccagtgctctgcccagggtgagcatgttgctttgattgcttggatgagagcatgatttaagttataggaagaatctggctcatttcccctggtacccaggtcattttccgattgtaaatcagcgaccttagggctgtattttcctctcaggccacaagggagctgtgtctttatttttttcctgaattcaaattgaattgtaccaaatacagtcctaaaggccccattgaggtcctagtacctccccaacatgtctggcttcctgctcttcccctcctgtcaccttcccaaaccaaggagcgcgtcccttagatctcagcccttacaatggtctttattcggcatgtgttgacatcctcagagcctaccacagggattcaatgtcaatatttttgtaacaactgatggccctcaaatggggagatggaagagaccaaaatcccacaagaattcagcaaaatgagacaaatatgtgacacaaacaagtcctcggtgttgtgctaagtccagagctggcctgctttacagcttagctctccgtgactcactggtattcttaagctgctgagtgcagctgtcattcggaaagtacaaggtgaacattatccgatgaagtcttccatctggcctatttatttatccttggcatctcaaaactgctgtttttggttccgcagtagggttacaagacaaacattttctttttaagttcaaaattctggagcagatatttgaatccagactgaagttgaagagacacagagaggagaagaaaagagaatgctatgaacggcagaggttagaagcctactccatccagttcactcttcacagcacaatggcaacaacaaaatacttgtttccagactcccttgcagcttggagtggccaattttatcagtgaggaaggaatggaagtacaacattctagaaagaaggaaagaaagaaagaaagaaagaaagaaagaaagaaagaaagaaagaaagaaagaaagaaagaaagaaagaaagggagagagggaaggagagggaaaggagggagagaggaaaaaattgtttctttttattttatgtctatgagtgttttgcctgcatgtaggtatgtgcactgtgtgctgcctggtgctcaaggaggcagaagaaagtgctggagccctgatgtttgtgagccactatgtgggtgctgggacctgaaccccagacctatgcaagtgctcttcaccactgagctgcttctccagtccaatcattctttagtgtcattggggatcagttctaggataccacacccttctcaaaacccacagatgctcaagcctcctatttaccccagcacagcatttacctgcaactgctagcagagccttcatactttaaataacggccatattacttataacgcctaggacatgtcctctatataagcagttgttgaatggtttgtctagaaaacagcagcaagacaaaggagacaacccatgttcaccagggatgcaattacaaggaatttttaatctgtgattgaagggtctggaactgagagacacagaaagcctatggaactttcagaaatgctttctctaagagttgagttgggcagctgaagagatggctcagtggctaaaagcactggctgctcttccagaggacctgcgtttaattcccagcacccatatggcagctcacaactgtctgcagctccaagatctgagaccctcacacagatagatatacatacaggcaagaaatgaagcaaaacaaaaatgtaagaacaatgcacataaaaagtaaataaaagagttggatcagctgtgagggcctccttttccctcatcaattacttaaaatggaacctcggcatccatgtcagaccatgaagtcactttgatgtaacagaaatacaggagccactggagacaggagaggcagccttgtagtgggttactctgatttcctacatatgacagaaagatgaacctattccacctaatattatctgagacttttagtcgaatgacagaattgaggggctggtgtgtaattgtgaaagagagtgcttgcctggcatgcacaagagcttgagtttgatccccagcactgaaaacaaaaagcaaacattgaattccaaataatacattagagtaaattttattttgttaaagttatattatcttatatttacttaagactatacacaatacaaataaaaacagatgatagatagatagatagatagatagatagatagatagatagatagatagatgctagacaaattatatactaaccacagactaacaaaacccacaatatggggcacaagaaacttcctttagtgtggttggtcagggtagcccaagtgactcccaaaacaatacaggctcttactgtagctctcattggcccctcagaggttaaagatgggtccctattgctgaaaatatggaatatttaggacacaagactggagctggatctgacttgaaggcctccttcatgcagtctagtttccatggtgccagtgcttgctatgtacattgccaacagagggaagcaattaatagtcccacccagctgcgatacctatgaaccacaacaatgaccacatggcaagatatctataaaggttctgtaagtggctctcacatgttggtgtatccaacagctatctgattggacttaaggcctctcaacaggaggggaatcatacctgggactggaaacttagccaccttccccagggttcatgagatcacagatcttagaagagaatctattgctgccactttgctagaccagcataattccttactacattctaaatcttacacccacagataggtgtagctactgccaccaccccatcaaaggacttctctttacagcaaatggagactatcacagaaaaccacagtgtagagatcaacagatagtggggagcccagccccaaaggatacgtctacatcacagctcctgcatctatggcttagggaacacaaggaagaggagacagaaagactgtaagaggtaaaataccaggaagtcggctgtgaaacagtgtctcccagaaaccagaaatggctatataaacaagaccagaatgatggcattatcaatggacatgccaacttggaaaggggaagtccttgtggggtcctgcacctatacaaagaactacaggcaactaatgactgctgggagaaggagaattagcctttcccagggatgaggttggttgtccaatagaaagtggtcagccctaagaccttaacacaaacaacaaaaacagactcagcagggagtctttgtgtgtgtgtgtgtgtgtgtgtgtgtgtgtgtgtgtgtgtaaataatcaaagaaaaagagattatcaacttgatagtggaggtatgtgagaggttagctagggaaagtgatataattctatttcaattaaaagtatgtgtgtactttaaaaagtcatctcttaaactatgctagggcatttctactcatgttggcagctagagtgagcagttttgcttagaataatgaacttaatatttcttgtgctgctcctggagagggaggagggatgaacaaaggagccaagatggtgctagagaaacccacagaaccagttgacctgacctagcgagagcacggagaccctagtcataaagctgcggaaacagaattggaccgaaccaggccctctgaatgtgggtaccagctaggaggtcaagacagtctatgggacctctaacagtggagccagtctttaaccctggagcacaaatcgactttgggagcccattctctatggagggatactactgcagcccagatacagcaaggaaggcctaggcctccccagaatgtatgatggattttaaaggtcccctgtggagggcctcactatccctggggaggagttggaggataggttgggggcgttggtggggaacatgggagggtgggagagtgagggaatgggggaatggatatgtaaatatgagtagtaattaaagaatttaaattaaaaaaaagaaaaaaatatctcttgtgctcatcaaggctaaggtgcttaaagtcacccagttaaaacgtggaagcgctaaaattacaattcaccctatgcatttgcttgaatgttacttaaaagcatgagtaactatctttaacactcatatagccttgtagagttttagttgttgttgttgttgtttctggtttttggagatggggtttctatgtgtagcattggagcctgtcctggtactagctctgtaaatcaggctggcctcgaactcacagagttctgcctgcctctgcctggaaagtgctgggattaaaggcatgtgccaccaccatctggccgagtttgagtttttaatgagtacatatgattatgcttaattcttatgaggctgtgtgtaaacggttagatccaccccaatccatactaaatctgagacatctagtagacatttgggttttccaacaatctcccttctagattctgctaggcctttgtgagtcaggttcctggatgtctctttttcttctagctctccaccatgcctgtgctggctgggttttatgttgacttgacctaagagtcatctaagaagagagaacttcaactgagaaaatgcctccagaacatggttctcaacctttcctaactctgcgaccctttaacagagttcctcatgttgtggtgactcccaaccataaaaccattttatttctacttcataactgtaattttgctactgttatgaatcataatgtaaatatttgataggcaaccaccaacggggttaagacccacaggttgagaatcactgctccagaagatctgtctgtaggcaaatctgtaaggtattttcttaactagtgatcaataggggaggtcccagcccactgtgggtggagccttccctgggctggtggtccagtgttctataagcaatcaggctgagcaagccagtaagcagcactcctctatgtcctctatatcagctcctatcttcaggttcctgccctgtttgagttcctgtcctgacttccttcaataatggactatgatgcagacgtgtaagccaaataaactctttcctccccaacttgcttttggtcatagtgtctcatcaaagcaatagtaaccctaactaagatcctcagtcatcagtaacagctcctgtgtgaatcaaaagagaagactacctgagcttccacacagtatctcccttgtttagagaatttgggttagtgggtggttccatggtcaaggctgactttctaagattacactttcaaagtcagtcagttactgtgctgataatggcttgagaggtagaagagagcaatcaacaagactatcaattatctgtggcaacccaccagccctcaggagaggagaccgtctctgtttatttgggctgagctcattcatggagttggagtgatgattggatttacttaggaaacttggtttggaggcattctggcaactgaccctcagctaagcatgcacacaaaccctgagatctgtctgcagatacgaaaagtttaagtcgtgcccctacagcaagaagccatctgagtccctcttcccactgataacagtgtgctgttctattgttgggcctggaccacgctaagccctagaagagaggtgagtaccccatacaatggtgctgttagggctcacagctcagagcctggctaagacagcctgccagtgacccagactccctaagtattcttcatacagtgaaacaaatttctgaatgcctttaatattaaccattttaaaaagtttatttattgtgtatacagcagtctgcctgtattccagaagagggcccagatctcattgtagatagttgtgagccatcatgtgattgctgggaattgaactcaggacctctggaagagtagtcagtgctcttaacctctgagccatctctctagctcctataatattaatctttaatgttctttcaacatgatgttaaaaacaatggttgacatgggaataaagtctttagaaatgcataagaaatagctacaccgcctatataaggctaggtcctggggctggagagatagctcagtggttaagagcacttattgctcttgcagagcaccggggttcaattcccagcacccacatggtggtttacaatcttccataacttcagttccaggggatctgatgccctcttctgaccactacaggaccaatcacacatgtagtgcacatgcatacatacaggcaaaatactcacgggtggaagagcaggaggaggagaaaggggagaaggaaggaatctgtttttaaaatagctagatcctttgtggttggcctaagcatattttcacatttaagggaaacagtacaattgggttctactgcatgtagcagagaaatgaaaggatagtggcttaagcaaaatttactgaataaacaagtttgtttttctttagttgatcagaatcctagagcagaccatcaggcagaattaaggatatggaggtaaaggccttttagtttcctttcatctttttgttcctggacagtcgtcacctcactacaggtggctgttgggatacctctaatcgcatgcaagcctgtgttattctgtaaaagcaaaatttcctcagccctttaggtagacattcaggtagcctcttccccaaatttttccttgcctctgactagctagaactaatcacgtggccatgtgtagctgcaaaggtagctgggaaatgtagtcttttaactgacaaattaccatgtgtttcccgtgatcttttggtcttggaaacattttagacccttaaaaagtattgaggaatgccaagaagtcttatttatggagcaatatgtcttattatttaccatatcagagcctaaaacaaaaaatagaaaataattatttttcattaatttaaaaataaaaattatgtggttttgtttgttttggttttttcagacagggtttctctgtggctttagaggctgtcctggaactagctcttgtagaccaggctggtctcgaactcacagaaatctgccggcttctgcctcccaagtgctgggactaaaggtgtgtgccaccagcttctggctaaaaattatatgttaagtaatgtgttttccaaagcaaaagtcccaaaagcatgataagcgaagttttttgtttttattttttacaatttctttaatgttgaacttagcggtgtcagtcctcttacatctgcttccacctttaatctgttatgattttgttttggttaaattatattaataaactcagacctcttgtagatgtgtagtcagaaaacagagaagtgattttttaagagacttttcagatgatatggatatttttcttagacttgacaccaaaatgtatgtgatagttatccggaaaggtcattgcaatatagagtctgaagccatcttcgtgaatgtctgctggtctttacattaaaatgcactgaaatgtttatacattgaatgggtttctcccacacatgttattgtacagtgtcatgtcatagtcatgtggactggtctgtttataggttaaatgtcttctcccacacatgttattgtataatgtcatgtcaaagttatatggaaagtattcgtacttcaagctgtgcagatcttttgaatgtggacatatttcattgtatagtatttcttaaaccacattttttaaacatcactactggtcttaaaggaaaggcctactttggggatactgtcaagctaatggtgaacattgcttcccaaagttcttgttttcgtgtgagaggttgagggttatgactcaacaaatactgtcaggtatttcatttgaagtggcagattcattgttcaccgtgtctcccaaacacatgagcctgagtcactcagagctgcctacttttatttttgaaactagcttttactacacggcccagaatggacttgaacccttgatccttgtgcctcttccttctgagtattgtaattacaagcatgagctaccacaccccggtcagtaagttcaaatggttcttgagagaaactgttggttcagccagccacccattcacagacctgctttcttcagagcgacgtgcaacagatgtgtgttgtatgtgcctaccttctcccagactactaaaaagacatgttcccaaggcttggtgtttaaccctttctgtaaggcagtttgtaatgaagctgccatttggtccctctacactgagggttgaacctaggacagtcatatgctctgcagcgctctcccgaacactgttcttaaaccctgtattatgaaacatgttgcccaggcggccttgaactttagccttctgctcagcttcctgagtacaggccaggtttagttttcactgtaagtattgggggaaaatacagctatttttaaattgtaatttagtcagttcacttatttggtttttgagaccaaataagtttttgtagcccagtttggccttaaagtcaacagccctcctgcctttgcctcttcagtgctggcgttacagatgtgtaccaccatgcttggctaagaactactgcttggcaatgtgctgcttcattactctcccacgcctactattacaaactaccacaaacggggtgacttaaaacaacagaatttttttctcttgcagtctggaatcaagatggtggcagggccgcactccatctgggaattccaggggacagtctgttccttgcctcctggtagctgctggcattccttggctggtggccacatctttccattctctgccagtgttacgagttggcattttctctgacctgtgaaatcttcctctgtctcttttctgtaaggatacctgtaggtaatggcagtacccacttagatgacccaggataaataatatctccatcttgagggccctagacccatcatatctgctaaaactgttttcccaaacaagttaaaggtgacatgtttcaggaactaaggtctggtgtctgggtctagcacgaacggctgctttgactggtgccaagccattggcagtctgatccactggctctggcttttgcaacatcagtaaactgtccatatgatgtggatgttttagaatggtattttattggtttttcccctgcccccatcagtgttggaggtgggagcatcccagggagtcctagagatctgtgtgtatcctctgaccaatgcagattacatgtgaacagagccagttatgtagatagaattttctgctacagtagccaaggaagggaagctggtctttgtgctgcttttaggggacagaaggtatgaactctcacaggacacatcctcctccagaggaaggcttccctggggattctatgcctgagctgagctccacagaaccctgatggctgtgcacagtaggtgtgcctgagctcctcagagccctgaagggtatgcacagtaggtgtgcctgagctcctcagagctctgaagggtatgcacagtaggtgtgcctgagctccactgagccctgatgtgtgtgagcagtagctgtgcctgagctcagcaaagccctgaagggtgtgaggtaggtaggagggttcctccgagaaagaaagagcttctggtgtggacagagagctgacctggggaccagcaaagcacacaagaatgtcccagggcagagcttcaccatactcacagtggtcagcctatttctgtacaccccacccaggctgtcccttacagagaagccagggtcacaccaagcctctgggtagtgtcccagttggttcaaagagccaggctgcctggtagctcccctctgaccacactgcctctcccaggtgtggagttaattaccccaggaactcccagcctgccaggaaagccagttgcttaggttcctcccattttctcctctctaggtagaaggtggtacctcctgaggacccagactgctactggcaccccacacttttccaaggtgcaacagcaggtctggattggaaacgtgcatgcacctgctaccctgcctggacatgtcatctgggaacttcagcaacaaaggcacatggggattatcaaatgaatgctgctccagagacatggagcctccaatcaatgtgaaagtgtcgtgagcatagtgggtacagtgttgcttatacattgatgtgtatacattacacttgtgtctgtgtcagctttgtttctgcttggaagactgcaacagggtccacgaaaactattcattagcagaactcaagaagacagggtcaacagcagatgtccacagagagaaatgcctccatcaggttagcctgtgagcaaatctatggaagcattttcttggttaatgattaatatggaagggcccagttcactatgggctgtgtcctccctgggtgggtggattccggttatgtaataaagaaaactagcatccggagagatggctgcgtgtactgttctgccagaagacctgagttcaattccaagcacccacatggaggtttacaaccacctataactctagctctagagggatctgacacactcacattaatttacacacacacacacacacacacacacacacacacacacacttatacataattaagaataatactaaatataaaataagaaagcaaactgatcaagccatgagaacaagccagtaagcagcattcctccatgtcccttcctctgtcctgcttgaattcctgctctgacttccctcagtgatggacatggaagcctaataagccctttcctccccaggttgcttttggtcacgatgtttatcacagcaacagaaacctaactggacgagaatgtgtgttaattcatatgaataactttataaagaggtgctatatgaatctgatttcttttttttttttttttttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnncctgcctctgcctcccaagtgctgggattaaaggcatgcgccaccaccacccggctctgaatatgattcttaaaagtcattagttagtcttccattttccattccagaaataaccattaccagttcttgtgtatagtttgagttttccatgtataaaagtattaagcatatacaagaatatttcatacttattcatgtgttcatttattatttatgtattggtttttttactcacaagggtggatgagagaatgtgcagcccaggctggccacagtctcataatcctccacctctgcctcttcaacatccaccagagtgtgccactgcaaccagctatctctgtacctttgaagcaggggatctcagcatagccctggctttcctggcctagaacttgcccctgcttccttagtgccggaataaccagcatgcaccactcttgggtccacattgaaaatgttattcttttgagctaaggtctgagagagttagacagggaaaatagccctccccttatagctcacgtatgaacaagggctggagagcacattcctgtttgagtctatgatttacaccagtgtaggttttgcaacacagagcagaatccttctgaaacccagggaacggatttccttacccattcatctggtcgtttatcttcttaaaagctcaagacaaacaaaattccctgtccgagacctctgtggcttcccaaggcgggtgagaacagtttccaaggcgtcgtctctgctttctgatttgtcatcaattcttccactgtgaccccatgaagctttatttacagcagctttctgttgattttatagccaactgctgactgcttggggcataaaaaccttgatgatttacaagtaataagtgaggaagaaatccataaatcagactgtataataagagaacacaggtgaatgagtgtgtacacacctctgagagtaaaattgtatagggcaatattttaataaagaccaagtgagaggcttcacctttgattttgaggaattcaaaggagattttatggtttctaggcagagactgttacagaaaaaaaaatgtattgaccaggtcaaagtgttgaagtttgacaaggattcccaatgctcccaaaacaattctgtgaaagataattctcaaacacccaaaatccctcttgtcaaacttttttctcttttaggcctctgtgtgtgtgtgtgtgtgtgtgtgtgtgtgtgtgtgtgtgtaggggggggtgtctaataacatgtttaaagtagagacaaaacctacaaattccataggaatcctacagctggggggctgctgacaaacagatgtgaagtggaaaaaccttaaaaaacatttttgtttggaaagtaaagtctgcttaccactagaaatgtattgcaaactccctgccacccaagatagagtataaaacatccagagttttaggcatttaggtattgagtaaaataatctcattttattgggatcttgatgcaaatcaaaaaagtatgagaattagaaataaaagaggggcaattgcgtactgactagatttttgatatggggcaattatacatttttacatgtgaagataggtgttatagttgtttatgagctttgtttttttaaagatacacaataaaaattgcttttatggttctctatgtagccctggctcttctagaattcactctgtagaccaggctgtccccagaatcagagaacctgcctgcctctgcttcccaagtactgggattaaaggcatgccccactgcctagcttaataaaatgttttagattaaataatttggtcatttttttttaaatgtgcaggtgaccgtgcatagtgctgttaagttgataatcattgagtttgggtgatggctatacggatttcatagactattatcgtcactcttctatttgttccaagatattaaatcttgtgaaaaacacataggcccagacatggtggtgacacctataatcctggcactctggaggttgagccagaaggatcatgaaagttgaggtcagcatgtctacgtaatgaaaacctgtctcaaaaagagaaaaaaaaaaaactcaggagaaagaggcaggtggatctttgagtttgaggccagcttggtcttcagagtgagtgccaggacaggcagggatgcacagagagaccctgcccccctccacacccccccaaaaaaaaaagaaaaggaaggaagaaatggagggaggggaggggagtggaagggaaaaggaaagaaaaaagagagaaaaggaaagggaaggggaaggaaggggaggggaagggaggggaggggagggaacagaaaggaaggaaagggaacggaaaggaaggagaaagagctcagttgagatagtgcttgcatgcaagcaccaagaactgggtttgagccttgagccccagaatcagttttaaaagaaggcttagctatatacgtgtttaaaatcccagagacagaaagacacctgggcttcactggccagccagcctagcctacgtagtgagttccaggccagtgagagaccctgcttaaaaaacatggtagatgtcaactgctccatatgtatacacacacgtgtgcgcacacacaaggcagagctccagaagacagacatgaaggtgtatgcctgccgtcacatctaatacaatgttgagtgaaggggtccatctccaaacaaacagacaaaaccctgcaaacagctggcaggctaggtcatcttttgctaagttctcatacagtcaccttgcatttgctactcaacagggacaaagtattgactgtgtacaggatcagtgaggcccttgtggatgctgatggtgccgtggacattaagatagcatgcaggttgtgtgtgacaggtggggacaatgctgggatctataccatatcatacctgatggatactggaacttctcaattcatggttcactgaaggtttccatgttatggcttcagagaggagcatcggtctaggatacagtcacccccacagtattgaggaaatcctactccacctgtctaacagtaaacaatgtcaaagggagtcccacaagactgaagctgaaaacagacacccaaggtcagtgctccaaaaacaagaggctttgtttttctactgtatcaagaagaaaagcaaggggagagagagctgaaagggctgtttgtgtagccaaaggccacagggtgaatttggaaagttgctacatacaggtttagtggagcaaaggggaagtgaagggagtccctggggaacctatacctgcagaagtgctgacccagtattggaggagggatctgcctgcccaggctcaagagaaaaagggtcctactggctctattgaagcatcttgccatgggagtgctggtcttgcttctcatgagctcatgcctgctgcaccaaaggcatcaacagctctcaactttgtcaaccagaagacacaactcatctgctccctgattggtaacttctttgttgttctttggttgtcattgtttcgagactcagcctagcctggcctaaaatttcctgtgtagctcaagcaagctttgaacttggggggatcctcctgcttcggcctgccatccttatcccagaatgctgaagttacaagagagacccaccatgcccataggaggttcttaaggaacttgtttcctttattcactagccttttctccatgccatctttggggccctctgctggaaaagtaggctcaagtcctaaacaattgcagttcagcgtgtctactagcaccataataggtcagtgtctaacctcaatggctctaaaacagcttatacttgctccataaagcgtagtagtgaccctaccttatcaaaactgttctcagtggtgctaccagaatgttctctgtccagacaatgattggcagcctaataaaaaagaaatggtgccagtcccataacatcaacagaactgggtctttcctaggattttggtttttacttttttttttccaacgaagtattctgggtgtttgtataactgttattggtcttttcattcaaacataaagttaaatatatacatatatactggatttttggaaactagctgtgttgaaactttgagggaaaaaaacttcaccatgttgagttaccattgcacagaaattaacagctttattaaaaatgttgaacttatttttttcttatttgtacagcagtaacacacagtattaaattgaaaagtcttatcggtgtgggtttgattacaacagctactaaagtatatatatatatatatattaaaaaaaccacttgtttcctatagtgaagaagacccttttcagcaacatttttgaattttctgtaggtggtctgccacatgaccccactgaggctgagtatagtgtgaagacgctaataagcctctgggtcttggcctaacagatcacagttctctctttaaaatactcccacagaatcctgcgtttctagctgctgagtcaccgcgttcccgggatgcctgtgggagccaaagacttcccacgtggcccctgtgctatcagagcccccaggtgagagctgtcctcaggctggcccctgctgctctgccaccaacagcagcccccatctcagttggctgaccgatgctgcacccagcagctgggtcccatggcccagatcacagccattacagctagtatggctagcaggctacccactggctagtgcgatcactgaggtggagggagaaacgctgagacctcagaagccgatcgatcctttcatcgggagccttgggaagcagcagcagcagcttccttgtttctatgagcgaggacaaattttgtgtggtgtttaatgagggttccagcgaagtgctgaggccatgtcagactgcaaatgagttagtctaatggagttcacccccttgctcatgcaaatgaccctaatgaaactcaatgagccaaacatacaacacacacacacacactcatacacccacatgctcacacacacagtcatacagtcacacacactcatacactcacacacagacacactcacacacccacatgctcacatacagtcatacacacactcacacacatgcacacacttgctcacacataacacacacacacacatactcatactcacacacactcatactcacacatagactaacacacatgcacacactcacacacatgcacacacacatacactggcacacacagagtaagagaggcacatgttgggaaggagggtttcaatgggacagagagaaggcgataagaacggttaatttttttttaaggttcaaattgaagaaatggaaactcatctctgatcaccaagtattttcacctcaaacaatgaaattgatgatgaaagtacagggtgcaaggctacatgttaaccttctcattattcacaccgtactgcctcacatgtcaccagactgttccgactgcattgaaggtcccctgaggtggtggagaattgggggctgggcaaacgattgtgtgtctcacagcaagaaaattagcgagttcactccctgtggacaaaagactaaagctccctttagggctggtgtagcaggtaagacagcttctctggcccacgtggtggctcttctgctgcctcccacaccggtttgcaggctcctccctctgtgtgctgtccttccttccctttctagtaaatatgaaagttcctctaagttgtccctacatagtcctcactccctgaccaacaccaaccagtagctggcctgaccctgtgaacagcactccctgggtttacacaggctgtggctccgactttacttctccaggattccccattggaatctaagaataaccaatagataatagagaaagtaaccagtgtctatttatttccccactaggccagcagcaaccctgagggccgagctgtatctgctcttttcctggtttggtttttcaaaaatatcttctggctttggggccaatgtgccaacacaaaatagatgtcaacaaataagcatggcttaaaaaaaaccaaattcccacccttatccttcttttacaacagagttgtgtgtgtatcaggctggcctcagatgtggtctggaacaaacaataaccttgaacttctgaccctcctgtttccgcctgagtgcttgggtcacaggcatggaccggcatgatcagcatatgtagcagtggggatcaagccagggctctgaatgctatgtttgtagtatatcaactgaactacactcttagctcccaaattccagttttctgatcccgacactattgcaaacctcacatacaccttaaactcctgaggacattagtcctgaagtagcgttattggagacataaatgacatctatgttggcatagggattacaacagtggtgttgaatgattgtgctgcctggagctaaaatccccagaggtcccattcctgaaaagctgactctcccagcaatgccaatgtgactgtctgccttgtccaacccagctctgtgcagattcgctttcctgatattttcctttccacgctcattatgactcaaatcatgattggatgagggatagggctgtgtcatttgtcagtcagcatgtcattaatgatgctctgtcatgttctcttctcccagttttctccctaaagtcagcggcccttagctaagagacccttagctaagaattgggggattttgctggtcgtgttggtgcctttaatctcggcacatgtagaggcagaggcaagtggatctctgtgagattgaggccagcctgatctacacagttacaatagtgagtgtccaggatttcatgaacatgttggatagagagtcagcatgctgagtataaagacttctagttttctattacttgttattaccaatgtgaaaactcactataaaagcttttatccataatgcataatatgaatcatagtaataagccaagattattttactatcatagaaaaagctagatatttctgataaaaaataaaaataacatatatatatatatatatatatgtatattaattcccaaaaccttaaagacctgcttatttttgtttctttcctgggaaaaacacctttaccatgaatggccctttctctttgtaaaacctttagacacctaaagtctgcacctttgttatggttgctgatgacacagttgagatttaaaaagatgaaggtgatcagcttcctgtgttctgagtattatgagctcttctcacctgtggagatggtcgccttgattcacagctgtccagtgacagggcagcttgaatctgtggaacgttgtgtttgataagccacctggctgagctagttgaagccaacagatgtagcctgggggtgggggtaggggagtggggaccaggaactcactcacatacattataccttgaatttcagccttgcagaagaatatagtagcagtgggagtcactgtaatttggtgacagcttatggattttattcattattccactgatctcttccacactgtctcatcagccatccatactattctaacatgaggcattattttatttcactctattcatttatttgttaatgggctgtcccttttttatttcttttacagacttttcgatatccaagggaaaccaaacagcaaccaggttgtttgggataagtaagtcgactttggaaggtctggcatgggtgcagggaaatctctatggggcctcctttctcttccctgcttcactgtcatcactctgaaagctgtcatgactgctggagttgaaactcccaagacactaatgccttgaaatggagacggggtgggggtggggaaaacaggtgaaccttagtagagggatcttacttgggtttgtttttgtttttgtttttctggcactgagcatgctacatatcattctaagtgatgctgccagctgcagagaatttcttacctctgagaattcaaacccgcagcagggcaatttccccagggcagcttaatttaacagtcttgtgacatttcacaccccacccccacttctttcccagcttgaatgacatctgtaagattgtctgcactgctttggcatttaacttttgaagatcacgacacaaatttctccaagtatcacatcacaatgattcaaatgtccattctctagcattacaatccctagcgagggagggcatatatctcctcataggggggaggagagaagtgtacacagtcctcttcttccatctgcatcccttctagctggtcggcatcagagctgggcctgaaacagcacaaaacacagttgcacttgcagagatccattgccgtcaccctgggtggcaggttacactgtttacagtccctatcacctgcctgtaggtccaaacatagccatagatactcattgtgatgctaaatgggagaggaacaatcccagcacccagcatacctgtcatttccaacagccacgaaaggagggtagccctcgttctccacaaatgcagcattgtcttgagggtaaatggtatagtactgagggggacttggtgcggcagccactgccccgctagaaggtacaagaccgcaagggttcatcatgggctgcagataggcggcgttcatccccagaggctcctgagaagcgtaaggaggaggaatgtactgcaccacggtggccccgtggaaggtgatgggctggttgatgccggtgaaaacgaacgactgtcctcccgaagtctggtccgaatccaggaccctttcctcactttctgtgcacaactggcaggatagcattttgaacttgcacacagcgatcaggatgaaggtcactccgactgagaggaggatgggcccgaggagctgggtccattcaaagtgggagacaccctggtacttgatccagcccatgacagtgaacgtgatccccaccagtcctagaaagatacccgagaaaagcaaagtggcccccgccttgtcgtcgtcggacacctggatgtcggcggtactgggtgtgtaaggagtgacagagaacacattaagcgggaagtcctctgagctgctagtgttgtgctccatggcttcccacacaactatctaacatgagaggagaccgagtctgtgggagcagggagtgcaggttcaggttagttagagtaggacctttggttttccgtggttaacagagtataacatgcacaggctgaactttgtttagaagaactaaggtccaagaaatgaggtctgaagttttgttgcaggtttccagaaaatggaggtttctgttttatgaaacagtggccaactgtctttctactttacattcattcatctagacatctactcattaaataagaataataataaacacttctcaagccactgttgtgtcaggagatgctttcctatagtcatggcactgcactcagttgtgtttctatcctaccaaagccaggtttgtgtaaatggcagcactgctcccaaggtgaaaggagttcttggtgtatctaccacctgcctgaaacctaactgaactttttgttttggttttgattcttgatttttagagatagggttccagactgtcctggaactagcactgtagaccaggctggctttgaactcacagagatctgcctgcctctgcctctcgagtcctggcattaaaatagtgtgtcaccactgcctggggtttctggctgggtcacctcagcagaaataggggtccatacatagtatttccagtcttactcatgtaaggaatctcctaggccattttctaacaggaaaccacagctgagtcatttttacagaaaagacagctatttttcacagttccatgtttctgggaccaatatcaacatgctggcatctacagacggtcttctttctgccacctccaccacctgatgagaacactacagtacatgtctctcttcctctcagaaagccactaataccatcagagggcccccccacctgattatgtcccaaaggcttgatctccaaataccatcaatacatgaatccaagaagtgagtaacgtacaagccttgggattccactcaagccacagctctcagcaaggctctgagaacctgctgtatcctggcctgggttcacgtttctctagctttctgcggctggggagaaggaagacagcacaggagccctttctgtgtgccgcattgctggcagaggttttgcatgagcatcagatgtggtaagatgttgcctggacaccgacctcaggccctgtgttctggtggctgcacagttccaggtctccaatgtaagacaaacagctgactttttgaacctcccctgttttgcaactaagcctaagctgatgtaaagaatcttcaaagacattatctgtcttttatgactgactagagaatttctatagagacccatggacttcttcctccattgaacggcaactctggtcttgttcttttttcctggacagactttgtccaagcagctcctctcaccaatggttaaatattacatcaggttccttttgcataagtgagagagctgcccttttgtccaaggcagccttcttaaacttcttcagatgacaacccactattttctttttgataggtagagatggaggccagtctgccacatgaggttagtaaggactggttttactccccagctgtgtccctagctcttaaaccaacacaaccaaaacacccaagggagaagatcttgaagtgcctatgatagttaatcttcactctctggttaaccagacttagagtcaccatggagacacacctctgggtgtgtccagaaagatttaaccaaggagagaaaatccaccctgaatgtgggtggcacagtctcaagagcttagtaaaaagaaagaaagctggagtgatgtctcagcaattaagggcctgtgttgctcctgtagaggcctgagatttggttccctgcacccacacggcgattcacaaccatctgtaacttcctttccaggaagtatgctaccctcttctgtcctccctagcaccaggcaggcatatggtgcacatacatcatgcaagcaaaccactcgtacacataaaaaaatagtgaaatagatctattttgttttattttgctttttgagacagggtttctctgtgtagctttgtagaccaggctggcctcgaactcacagagatccccctgcctctgcctctgctgggattaaaggcatgtgtaccaccactgcctgagtagatctatttttttaaaattgtgaatgcttattttattttatttttttaagattttatttatttattatatatacaacattgtgcttccatgtatatctgcacaccagaagagggtaccagatctcataatggatagttgtgagccaccatgtggttgctgggaattgaactcaggacctctggaatagcagccagtgctcttaacctctgggccatctctccagccctcgattttttttttttaaaggagaaagtgaactgagctacagtattcatctctctgctccctgagtgtgaacgcaatgtgactgaatggctcacagctctctcaccacacctgtccctgccctgatgactgtaccttcaaactgtaagccacaataaacctttcttctgttaagttgctttgtcaggtgttttgttagtgcaatgtgaaaaataactaacacagtgccccatgggtctcatcaagactcttagaaaactggaacccaggtgaaccccaaatgcttctcaaagccccaagacttgtttctacctatctaaatgtctctctttgctaagagacatgacctagaacctcttgtttccctgtcaggcatatggaagagcagtatagtggcctcagaattcctctgagagcctccaaacagctaaggttgggccaccttgctgaaggagggaatttctttcctcgagtccacagacatcgacagatgcaaccttctaacaccaaccaccttctctctttggtcaaaatatctctgcttagccagcttaacatgttttccgggctcttacgtcttgagtctacatagtctctgacactcagaaatacccaggctctgaaaactgtccttctaaagcatttgtatttgccacttgtctttagttataatatacatcacatatttatggatgttgtgactagttactcatctcaatgctgtgaccaaatccctggcaaaaataaagcagaagggggagggttttctttggctcacagtctgaggatgctgtgactcctcgtctccagatgaggtctcatgtctggacagagcaggaagcaggggtgcaggtcctcagctggagctccctcactctcccaaccacacctctttattcagttcaaggccccagaccaaagaatggtgtccacattcctgcctcagttaaacttcactggaaacatgctcataaacactcccagctttgacctttggtgatgtgtcaaacatttactggtaataaatcattaataaccttattttagaactattctttggtatagatacaattttgccatttactaaagtaacagcaaatttgcatgcaaatggagttcgtctatttacttttatataaagaattaaattttgactgaatatttgatactgcagtatgacataaagtatgttccgtgtttgtctgcatttgattgacactttgatttaatgagcaccagtgctgagaacaacgattttataatcagcaatgcctcactcaaatgtgtggtataaaatgcctgaagtttgtttaggatgacaaaattttttgaaatttcttttctaattccaaaccaaaactcattgaaaaaatttttttatcaaggtcaagtttgtcattctagcacagggcaatctaaagacacactcagaagtaagggaaggaaagtatcagacgttcttatgttccataaccaaattatgatgttcctacaacaccagaaaagtgtatgcacagtcaaactaaggcagttggttccatgtgatagtctagaaaccaagcctgtagtgcaaatgtgaccttggaaagtgacccaagcttcagtgaagctgagtgatacaaccaacatgggtgagtgctgttggacacacatcagatccattttacatttaattttgaattgctgtttagacattgtgcattcagaaaccctagccaagttttcacagaccgtcatgcagtcacgtggcctcagacttaagttgtgctctgaaaaactgacgtttcataaaaagattgtttgtttgtttgtttaagggaatagggagaagtgggtaaagtactttccacacaagtgtgagaacctcagttcagatcccaacacccaggtaaaaccagccatgatagtgtacgtctataaccccagcgttcctacaggaagactggaggcagagtcactgggagctcgtaggcccatgtagcctggcatacaaagaagcaaacaagagaccttgcttcaaaaaaagcagagggcaaggaccaatgttaaggatgtcgtgcgatcactgcacacgtagtagcacacacacgtccacattaacacactcaaacatgtgtacatacctcataaacatatacacgcacatctcacctctctctctcttccctcctctttgtctagtccttaattagagctcattggaaggttctggaaactggaaattggggcctagctgaagaagatagatcactggaagcaggttcttagtgtgtgacattcttgcctctttccatcacccgcagcttcttatttagccaagcagagaacagctccgatctgccacccactgctaccaccatgatgtcttggccaagtgcaagagatcaagcaaacatggactgaaccctctgaaaccagaagccaaaagcaatctgttggaccagaagtttctctccagtattttgatcataggaacacaaaaatgcaaacacaccactaatgctaggatttttatgattataagcacactctctcaagtgattgacagctttggtgttcaagtcagtttcctgcttcaatttccaaactccatttctattctatgggtgtaatatgtcattgggttacatcatcctatagatgtaatatgtctatagaatatttgagaatattgagtgttaaaacttgaaaatcattttctagctaaatgtgtttcatgagcatccactgtaattaaggagaataattctactcatgtcatccatacctaaccctgtgtctggagagatggtgcttcattacagagagagtaactcatcatgggtatgcaaaggctgcctatgtctcctgagttattagttttctgtttcatatctgttgaaagcacctacatctgacacattatttcctttcaaataaacattactgctaattaactccctcaaataggaaaagccatgcctgtatggtgctgtgcacctgaagtccccacacttgggacgacagaagaagatagcaagtttgagaccagactgggctacatggtgagaccctatttcgaaagaccacaggaagcaaaaaaagggggagggggaggcagaagagaggagtggggaggaatgagagaaaaggagaagagaaaaaatagaacaaaggcaaactttggggtgctgttctcaacaaatacagtaactactgaagaagtctaagaaccccatcatattaaaaaaaaaatgtctgcacccattattgtctgaccagcatcccccgtcttcacaggaagcatgtgtggaaactgcactgaaaaacatgggagtggtcctcctctgtctgcagttgcaatgacaaatgaaaaccagtgaactaaaaagaaatacttaaaaggttgatgaaggccacttagaaattagtcctttggcctggatctattttacacaaatttaaaaaagaaacctgtaaaatggctacattattgacatctgtgcatttctgaaaacattaaaagtttccatagtcctttgcaatttttcaaaaatgactgctaaagcacattaaaatgcacctcttgagaagctaggcaaggtggcccgtgtctgcaatctcagcacctgggaggaagaagcagaagaatcagtagttcaaagtcatccttggctgcataagaagtctgaggccagcctggactaacaagaccctgtctcaaacaaacaaaaatgtgcattttgatgagaactacctttttcatttcgtctgcccttgacccaaatctttcttcagacacatgcagagaatggagcctcttccttcggaagcaactcctggtggtggtttttgttttgttttgtttggggactggggttgagacagggtttctctgtgtagcactgactgtcctgagctctctttgtagaccaggctggcctcaaattcatagctatccacctgcctctgcctccagagtgctgagattaaaagtatgtgccaccactgcctgccagatgatgttttatctgctgggctgaccatgatttaccattagaatggacctaccttcttttttcacataaatagatcacattaactttatgtttcttcagctttcttttttcttaatttcatccttcccaaattcatacaatttaactcagtatcttaataagaataagtgatgcaatcacagctggaagtttctcagagaagagctaagaagataacaacaagctactgagaatttagcaccttcatttcacagttataaaacctatagtttgaatgagaattctggacagttatttatagtgtagtaatggcatattttgggagagagggaaaacagacaccttttagcatggttgggagaatataatggagctggggatcaaacctagggctcttgtgtgctagacaagtgctctgatatagagcatatcccaaaccctgtcacagggtgggtatcttacaatataataccatcacacaggcaccaccaaacagtggtcattatactatggccatcaaacagtggcaatcacactgtggccattacatggtggtcatcaaacagtgatcacacgatggccatcacatagtaactgtcacactccgactatcaaaaggtggccatcattcagtggtcatcacatagtggccatcacaatgtagccattacacagtgacctcaaatagtggccattgctcagtggttgtcactcagtggtcatcacatattgactgtgacacagtagccatcattcagttgttatcacacaactgccatcacacactgtccactactcagtggccagtatattgtggctatcacacaatagctatatcacagtgactatcatttggtgcccaacaaacgttgtccatcaggctgtgaccatacacagtgaacatcactcagtggtcatcacttagaggccatcacactggtcatcacacagaagccatcacagagtgacaattacacagtgttcatcacacaatggtcatctcactgtgaccttcacaagctgtccatcttaaagtgatgatcaaagagtggccactgtgactatcacagagtcactgtcacatggttgccatctggtagtttgaatataattggcccccataatctcatagggaatagcactattaggaggggtgactctgttggagtaggtatggccttggaaaaagtgtgtcactgtgggggtggagagactttgatgtctcatgtatgctcaatccatgcccattgtctcagttcacttcctgttgcctgtggatcaagatgtaggacctcagctccttccccagtaccatgtctgccttcatgctggtgtgtattgccttgatgataatggactaaacctctgaactgtaagacaccccaattaaatgttttcctttgtaaaagttgccatagccatggtgtctcttcacagcaatagaaaccttatcatacaatgaccatcacacagagaccagcaaacagtgaccatcacatagtggccaccacattgtgtacatcatacagtggtcatcatgtattgaccattgaacagttaccattgtaaccatcaaaatgtggccatcaaactattaccatcatatagtggccatcacaaagtaaccgtcacacaatggcctcattctatggtaatcatatggtgaccatcacagagtggtcattacatggtggtcataacacagtggatgtcacacagtgaccaccaaacagtggctgttacccagacattatcacactgtggcctccatatggtggccgtaacagtctgaccttcacacagtggcaatcacacaatttggagggtttttttttaaaccataatttaatgtatatataaatataccatgtatgcaacatgtattcttttttaaattttattttcacatgtatgggcactttgcattcctgtatgtctgtgcaccacttgcatgcctggtgcggatcccctggaactggagttacagacagttatgacctggagtttgtatgctgggaatcaagcctgcatcttctgggaaaatgcttttaactgtgagtcatctctccagcccttaacaatacattctttagacagcttcacaggaatattttaccagactagagaacaaatcactgtagtcagtaagtatagggtggagagaggaatcctgaaagtctgatagcttcctgctaaaagactacacttcccagcttcccttgtgggctatggaactcattcccacccctatgagaggccgctttccatcttcagtaggcatattgaccatcctcacacttggatgacaaaagtggcccctcagtgtgaataaacactgtcaggcctaaggtcagaccatgcctctttctctctgccttctgtctctctccaactgccttttcataaaccaacatgcagtgccagagactgggaacatccaagtgatctctttggcagttgactttatgtctgcagagtcatcaaatgagtctatagagtgatgtcctaagccctcagattcttcaggagatgatgtaaatgaaagagattctctccaacctgggctcacctgtagtgctttgagaatataaccaagtgtccacccagatggagagctccaaggtcaattggtacaccctcaccttgaagcctacaaagaatataagggctttggtggtgaagtaaagtgcctgagtgaaaaagatccatcattgttctccaggagctgggcgatgcttgtagatgttttccaagaagttccaaaagccagtattgattgaaactcatttaattggcttgctttacaaattatgcctctaaacaaccagtctatttttacatttaataatgttaagaaacatgctaactgctgtcagtatgtggcaacctagagatttatccattgataggaggattaaagaattggctttagcctttgttaattcagtctatgttacttgtatattattttttttttacagagttgacataactgggtgcttttgtctttcatccgttggctgagtgtatagaatgcaaatgttatagagaagtttgtaaaggttctgttaagagttaatttttaaaagctttgtaaaataaatcatttacttttgacaaggtagtcctgtctctgggaatatatttttaaattcgaagttgaaaagtattttggggaggggaacagaacttagaatcctaaggtcctttagaatcaaattgtctctttacatagcctgacaatataaaatatattgactgtaacaatttgccttttaatactctaataatgcttatcattggtggactgggtcaattacagtgataacaggataccatatgaggattcttcaatagaatatatattatataacatgttatataatatgcatatatatatatatatatatcttgtaagagtatacttattaacattagattggcgtacacagtcaaatgttaattggtcccacagcagcaatctgtagatgggagagtcaaagaaactgactcagttcaggaagtaggaagctcaagaggaccaatgatacaaggctaaaggcctgaaggtccccaggagaaactctgctgtaagtccatggacaacagcagcagaaagtgtacccacctactcaaggatgggaagtgggcgtgtagacacccctttctttttcttacttgtcccatcagacgaccagtctactgggtggtgccacctatgtcttcccactcggttcactaacccatacaacaatccactcgggaaagactcactgacagtctccagagaatgctttacccacccgtaagtgctcctcaatccagtaaagttgacagcccaagctagccattactaggatctgctattaaaaactaaatcagttctgtgtgaacatgtctggcagaatctcccaagatgcactgctgcctagaggttgcagaagcaaagagaacctactgtgctgtcatttgcaaggggaaagaggcatactggacactgagtgagtgtgtgtataaaatacggctgatggctgatgggatacccaactgagaaagagaaccaggaagatgttccatttgtacagtgtcttagagcaggttgcccagctttgccaatcccaggaaaaacatttccatttcatttcattgctcagtgactaagccaaccctgactgcagggaatggaaggtgattcttctttgtaatgagaggaatgtgaccctcacattgcagacagacctgctgggcaggagattattgtggctgtcctctttgcaaaataccttccactgaggacttcttattccgacttctgctcacatgagaacacacagagattcagattggccgtgtctatatttgtttgcacactggctggttactaacctctgtgtccctaagagagaccaacccactcatcaacagaaccacattctggagttttctgtatctcctgtttgttttcactgcttttcagacttacacatcagacttcctgcttgtaaaccattcctggctaaaaagtgaaactctgagatgatggattaatgacataaatgaggaatggcattaaaataaaaaaagaggattttcaaggctagcagagacatgtgaaagtgtgtgtgtgtgagtgtgtgtattagtgtgtgtgtgtatgtgtgtgagtgtgttagtgtgtgtgtgcatgagtgtgtatgtgtatgtgagtgtgtatgagtgtgcgtgtgtgtgtgtgtgtttgaatgcttttaaaaagagtttagccaggtatggtggctcacacctttaatgctagaactcaggatgcagagacaggtggaaatccatggatttgaggccagcctgatccacacagtgggttacaggctagccaaagttctatcgcagggcagcaacaaaagaaaagagtttagtaatgtgacaaatttgagttttgtaaatttagatgctcagggcctgatttgtgatgttttctcagtgccgtgggccatattcattctgttttaactaccagtgaaaaataccaagctctctgatagtttttatctattgaaaatattttttcatatagtgcattctgttcgcagcctgcccccatctccttctagattcaccccagttctccatgtattcaattccacaacttctttttctctctatttagaaaacaaacaggccaataaaaaaacgcaaaccagaataaaacaaaatagacagagaaaagaaaacagaaaatataaaaaggagaaaatataagaaacacattcacacaaatgcacacacatacaactcataaaaacacaaaattgaaaaccatactatacaagcaaaagacaaggaaagtaaaaaatgcctgaacaaagaaagcaagcactatgagacaaaacatctccaaaaagaccattgagttccttttgtgttgggcatctactgctgggcacggagcctgcccttaagtgtggttcacataaccactgagactccattggagataagggatttgtgcctcgtgagtggttgtcaattggagatcacttctgggtgggagtagggctcaagtccatgtcccatctcaatgttggaactccatctggctgggacctgtgcaggccctgtgcagctaccatggtctcagtggttcatatgcatgtcagtactgttgctgatggaaggcaccatttctttggtgtctttcatccccactggctctcacaatcctgcatcatcttctacatagtttcctgaggcctaaaaaaaaaataatttttaaatgtcatgagctttgaggacatggaaaaacagtaatgtccaagattgtaaagaacctttccccaatattaattgactctatatgtgactctgtggcacaggatgaggagaggagagacagaggtagacactgctctgcatggtaggaccacatccatgtgtggtaggaacgaatccattgccatcatccctagaattggaaaacaatgaagtcaaaagggtgtagatagcctggctagggtctcaagtaattagcctgtgggctcagctttgcccctagattgtagaggtatacagagtctgagttcggagctaagttaccgaggaactagacatgttgatatcccacccaagccagacatcatcacatgcctgatctgtacatctagatcagaatcaggcaaatgccaggaagaggggtgagtggactcagaaaaccctgcatactcagctctgtgctttcagggagccaaggatgaagaccacaaaagagtctaagcaaatatgaggcaacttgcagtactcgccaacatcttcacaaagacttccaacaaaagagaacaaacagtatattaaaaagtgttttggaacactgcactggagcatgaactacctctaagaggctctaagaagagcctctacctctgtgaatgcctagtataacgcatttggggagggggagattgaagggagtcacagtagcaggaattatgaagttttatttatttaatatgtctaactatgttggcaaactgttaatattagcctcacggtaaaaagacagggtagttggctcatagcataccactgtagctatcccagtgttgttgaaaatgaaaacaataacaccgcatttagacatttctttgtttcgagaatggcatgaaccatcaaggtaaggacttctctgtgtgaatcctacctatttagactttcccctgactcaggcttcccaaggtcctggcaaggggtggggcctccatgttctaggtgattaatctcaaaagtgggaagggaagtatttgacttaatagcagatgcaggacggtgatctgtttccttcacttgtttttgaactgctcttccatgaagggcatgtacttgtccacagggcatctgcccgtgttcacttacagtgggctggtcaggtggtttccagcatgttctgacaaactttagtcttttctccttattgacctttgagatagcttgagagaactggaatataggtcccagccaccctggataggcacaaggcacaactttgggtcccttccagctcccttctggaagggatgggtatgcagtgagcatcagcttgctttggtcctcaaggattcatgttacatgtacagcagttgtccatggcaggacagctacactgaacgactcacagctatagtaagtttagctctcagctcttgagtcaggcccagatgaattacctggaggttcagggaagaatatgtctgagtttcttcagactgttggcagaattcattacccaacagatcttggattggggccctttttaatctagcagcacccagcctttctcatacaaccctccacagctggaggccagcacacactttcctgccttccctttcagctttatacttctgtctcaggtcatagaaagttctctggtttctatgtgattaaatatcactcacacacacacacacacacacacacacacacacacacacacacactcatgggagtgggtaaataagggagtatcttagtgcttctgtggtgtttgaatgaggaaacatgccacttgagggacaccaacagtccccttcccaccctgacctcacagactggaagacaatctggccaacaattgccattaggcccgatggatccagaaccctggaggagaggagaaaggccttcctgagaagggccgtttctcccaaagggagctggcctcttctcccaggctgggcctgttgtgctgatgtgggaggcaatgctcgggccacccagcgtgaactgctgctgcctgagatggaatctactctcctagctgttggcagagacagagggactgaggcccacagctgctctccactcgcagtctgttcccaggctccacatggttctgcaaccctaaatgccaccaagatgcgctcaactaacaaccacaagaactcttggggcggatgccggctggtcttcttggctgttctgaggcacataccctggccgccctggggagcagcaagttcttgcagacatgtgcatgatttgaggtcagtctccggctggatcctaaacagctgccagacttttctgtgcctgatgaaatacgaggaaaagccaaggaattcttcttgcttggagaatattaccagctccaaggaagcaaagtcccccctggaaagggtagagtacataagatggtggatctagaagttttggaaacctttcttgtccagaggcagatgcccaaggttgcactcacacgtgtccttgcaatctgcaacccaatactctgctccttgtcatgcctgacatatgaatccagaccacagttggacaactacaagggcagtgcctttttgtacctttgggagttccagaaagcccaatgaaaattagaattggatcaacaagaatcccgaatatccgagaaatctgcaataccaaacagtgctcatcaaatatcacagtagaagtcttgaagactagcagtcagcactgtggagatgtgtatgtgtgtatgtgtgtgtgagtgtgagtgtgtgtgtgtgtgtgtgtgtgtgtgtgtgtgtgtgtgtgtgtgtatgtatgtagttaggaatgagggagaatgtatcaacatgagggcaaaagtaaaacataaggtgtgtaaattaaaatgaatacacaaaatagtgtcatgctttataaaactctgtgtgtgtgtgtgtgtgtgtgtgtgtgtgtgtgtgtgtatgagcgcacgtgcagtgataagacatattgctgtgattgccttttgggaaaaaagcaatctgtgataggagtagagaaggaagggaatcagggaggaaaagcagaagaggggaagaagccaatgatgatgacggacaaccatggcttgaagaatgcaagcatcctgctctctgttctaggatggaaacaagaatggaaagcaaggctttgtcctaacttctcatccagtgctccgggtgactgactaaggtgtgtgttcagtataggtctgtccttatatccacaggggtgctgaggacttgaggggttgccaggattctggcccgagatgcacatgtgaagaaatctgaaagcctgcaatcctggctcagagctacagaactggggagtcagctccgggttcagaaacaagaggaacagatggaagctgttgggtgaagccgaagtgccatggtgtgaaaagaagccaggattgctggggagtggctgcattggccctgtgaaagcagaagctgatgtagtcatgggtaacatgcccacgcctctgtaaataacaggtcacccgtgctcctgtaaataaccctaattgaaccattggttaacacacacacacacacacatacacacacacacacacacatgctgctacttgggaaaaggaaggagtcagtgggaatgggaggggacaagacagggtaatgcaaatgaatatgattaaaacattatatacatgtgtaaagcatcataatgaaagacattattatatataattagtatgtgctaataatttttttttaaagtccaagagcagaaactttaacgagaggacactgatgaccacaggcacatcttcgtttggtgacaagcagtgtgcctccatgaatgagcatgaagctgacaggctacgtctctcctgtctttgttcctgctctgtggcctctgacctgtggcctgcatgtcacctctcacaatgtgtgcacccatagagatgctgtcattgtttgttcattcttttggctgagcagtgtgactatattttaggaaaactgacttccagtagcttcttcctttaaagccaccatggccaatttcagatcctcacagacactttccagatgctcctgtttgctgctgccgctgtctcactctcgttgccaaggggaggtcacagctgaaggtgcttctcttccggaatctagcgaagttctctgatgcttcttattttccaagttaaaagacaaggaacaaagtccagctccctctgggattttaaactggaagaatgaccaaagaatgacctcagagcatcactctgtcagtgttcaatggtcatgtgaaccaactgacctgtggcagccatgctgtgaggaaggccgtctgtccctcaggaggcacagagaggcacatggctctggcacacctggggactaccctgttacaccacagcaaaatggtcaactctactccatctattatgtgtgcaaattttcaaggttttgctcttaaaaacagtattgtcttgtgacagctccaaacattgttaacaaaaccattaagtgtcagttatggcagccaccaaaaggacttgctactggctcatgactgaagtaatgatgggccccttcaacctgcagtctgcgctgactctggataggaaagatatggtccagggtaccatatataatgttagagcatcctgtcataacagctagagcacaaccaccatggagtatggtgtgtgtcagctttccatcgctgtgacaaaatacatgcgataagcaacttaaaatgtgaaagattatatgcagagataccatggccagcctagacacaggggtgttggggtggagagctgccttggtcctgcctcaactagatgatgggacagacttagtagacttcctatgggaggccttaccctctctatggagcagataggaggagggggaagtgaaggggggtgggaggaaaggagggagggggaactgggattggaatgtaaaaaataaattaataaaaaataataatctcattaaactgctcttcagtgaccaagatcactacaaattaggattactatttacacattactcctaatataatataataatagtgataaaaataatataatgttaaaaaaaaaagttgaaagatttagtttgtgtcactgttttggtctgttttagtccagggttgcttgcttgtattgtttttggtcctgagacaaggcagagctttgtgactgaagagcatgtggaactgacctgctcacacaggtagctgagaaggagagaaaaagagaggaaccaggtacccaacaatccctcccaagcacgcccccaatggcttctttccactgaccctcaccttgtaaagtttccaccaacccccccccaccaccaccaccgaaaagtgacacaggctgatgaccatgccttcaacatacgacctctggctggcatttaagattgaagctataggatgcttttaaatctgttggacacggtatctcaagcagggccctcactgaggccttcacagcccatgtgccaagaagccattttaccagaagcagacttcctccatctttgtagccatctctgccagacacccaggaggtcagtaaatgtctgcaaaagaaaatttgttttgcctgctgtgtctgcttctggacccctcccctctcctctgctaaaagtgaaataatttatggatgcccttttcaacttctctcctgtctgtggccctgaccctctgatcagacctggacacaatctgagtaggagtgtttgaggaaacacatttttattcatgtggcctttggcaaagcacctcgaaaatctagcttgcattgtctaatgcagtccctgcgccttgcttgtcccatgcctttgctgggagactttcaggttggctggcagaattcaaccaaggggagcagagacaaagttgaagagggctgaaggggtggataactagttaaccattcacctccctcccatgaaggagagaaatgagctgctctctccaccacccacctgtgcctcagcacctgtgctcctgattcaataccattatcatacttgaaacttaataatcattctataatattacttgataaccatgtcatattacaacattcccagatgggactggagaagggactcagtagttaagaccatgtggtggtttgaatgagaatggttcccttgggctcagatttttgaatgcttgttcagaagttggttgaactgtttggggaggattaggaggtgtggccttgttggaggaggtgtgtcattggcggtgggcttgaggtttcaaaaactcatgccatttaaagttagagtttttctctctttttcccaggcctgtggatagaatgtaagctcttagctactactccagcaccatgcctgcctgcctgtctgtctgttgccatgttcctgtcatgatggtcatggactcaccctctggaaccttgagacccatatgaaatgctttattttataagttttactagtcatggtgtctgctcacagcaaatgagaagtaactaagacagagcacatactgctcttgcagagacctgagtttgattcccagcaccaattttgattcacagctgtctataacttcagatccaagccatctctttcctctgtcctcggagggaacaggcattcaaatgcaaatactcactctcagatgcatagttaaaaaataataaaatgaatcttttaaaaaaaaatcctaagcaaccctaaatggcttctgtagctttgtttgtaccaaatcaacatgcagttggggaccacacattgcattttgttattttcccttggtctatcagtttcttttttaattaagcaaaatcaatgttcaatgcaatgaagtaattttaaatgtatggtttggcaaacttaaaactttttatcacctttattactaccaccctccccaaaaatataggaaaagtctttcattttctttttataacctaccactccctctctttccccaactcctagcttgggaaaactctgtctttgcccaccttagatagctttgccagctcagaaactgcattagtacaggagtacaagaggagaagaagaagaagaagaagaagaagaagaagaagaagaagaagaagaagaagaagaagaagaagaagaagaagaagaagaagaagaagaagaagaagaagaagaggaagaagaagaggaagaagaagagaacaagaagatgggaagacgacaatataagaacacatccaacaacaggaaaaccaatatgacaccaccagagtctagggactctacaccagcaagacatgaacatcccaacacagaagaagcagatgagagcaaccttaaaaacaacttcatgcagatgatagagaacctaagagaggaaatcagaaaatgctttagaaaaatggaggaaaagacaaaccaaaagatgcaagaaatcaaggaaagccaaaaaaagccaagaaaatacaattaaacagctgaaggaaacagttctggacctgaaaaatgaattagagacaataaagaaaacacaaactgaggaaatactggaagtggaaaagctgagtaaacaatcaggaaccacagatgcaagcataacaaatagaatactcttctgagatggaagacagaatctcagatgctgaagacaaactagaggaaataaactcatcaagcaaagaaaatctgaagtctaacaaatccataacacaaaacatccaggaaatatgggacaccgtgaaaagaccaaacctaaggataataattatagaagaaggtgaaaaaaaacccaactcaaaggtgcagaaaacatattcaacaaaatcatagaagaaaacttccccaacctaaagaaagacatgccaatgaaaatacaagaatcctacagaacaccaaatagagtgaaccacaaaagaaattcccctcatcacataataattaaaacaccaaacgtacagaataaagaaaaaatattaagggcagcaaggaaaaaaggacaagtaacatataagtgcaaacctatcagaattacaccagacttctccatggaaactccgaaagctagaaggacctggatagatattctaccaactctgagagaacatggatgccagcccagactactatacccagcaaagctttcaatcactataaatggagaaaacaagatattccacgacaaaaccagatttaaacaatatgtaaccactaatccagccctacagaaagtactggaaggaaaactccagcctaaggaaattaactacactcaatagataatcccactcaacaaaaacacaaaataaaaggcagggtaaatccacatacaataccagtaccaacaacaaaccaaaaacaaacaagaataaactctccatagacattaatttccctcaatattaatggtcttaactcgcctataacgacatacccaaacttatgggacactttaaaagcagtactaagaggaaagttcatagttctaatgttcaacatgaagaaactagagaatagccacaccagagatttgacatcacagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattaaatggagagaaactcgatccaattcctctaaaatcggggacaagacaaggctgtccactctctccatacctcttcaatattgtccttgaagtcctagctagagcaataagacaacaaaaggagatgaagggaatacaaatcagaaaggaagaagtcaaactctcactatttgcagacaatatgataatctacattagtgacctgaaaaactgtaccagggactcctacagctgataaacaccttcagcaaagtggcaggacacaagattaactcaaaaaactccgtagccctactatacaccgatgacacattggtggagaatgaaagcagagaaacatccaccgtttacaattgccacaaacaacataaaataccttggggtaacactaaccaaaaatgtgaaagacctgtaccataagaattttgagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcaattttagattcctctattgagaattttttattttgttctgtaccccactttttaattggattatttggtattttggaaactatcttcttgagttctttgtaaattttggagagcaccatcccagacttcaagctctattatagagatagtcctgaaaacagtttggcattagcacaaaaatagactagtagactaatggaatagaattaaaaaccctgatattatcccacacacctatgaacacctgatttttgacaaacaatccaaatttatacgatggaacaaagagaacatcttcaacaaatggtgctggcataactggttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttcctgaacataacaccagtagcacagacactgagatcaacaattgataaatgggacctcctgaaactgagaagattctataaggcaaaggagataatcagcaagacaaaacagcagcccacagactgggaaaagatattcatcaatcccacatctgacagagggctgatctgcaaaatatagagagaactcaagaagctagtctccaaaacaccaaataatccaattaaaaagtggggtacagaactaaatagataattctcaatagaggaatctaaaatggctgaaagacacataagaaagagttcaacatccttagccatcagggaaatgcaaatcaaaacaactctgagataccatcttactcctgtcagaatcgcaaaaatcaaaaacaccaatgacagttcatgttggagaggatgtggagaaaggggaacacttcttcactgctggtgggagtgccaacttgtacagccactttgggaatcagtatggcaactcctcaaaaaaaaaaaatgggaatgagtctaccacaagatccagcaattccactcttaggcatatacccaaaagaagcacattcatacaannnnnnnnnnnnnnnnnnnnnnnnttcaacggaagaatggatagagaaattgtggtacatttacacaatggagtactactcagcggaaaaaacaatggaatcatgaaatttgtaggaaaatggatggatctagaagaaaccattctgagcaaggtannnnnnnnnnnnnnnnnnnnnnnnnnnnnnnnnnnnnnncagattttagacatagagtaaggattaccagcctacaatccacactgccaaagaagctaataaacatggaggaccctaagagagacatacatggtcccatggagaaggggagaagttcaagatctgctgagcaaattgggagcatggggaagaggggggagggagctaggagaatgagaaagggagtggaagagggatgccaaggacatgagggagcagaaaggttgagtcaggggaagaatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactctgatgacaccctatggaaggcctcaccatccagggggagcagaaaagatatgtgacagataaggttttagttggggagggtgggtaggggaggacgggtgggagaagggaactgggattgtcatgtataacaatcctgtttctaattcaaataaaaaaaaagttggaaaaaaattgcaagatttctgaattatgtaagtgtatgtttgttaaagagcacacacacacacacaagcaagaggagggcctctgtgggaaaggggagcagcaaaagtgggagcagggcagaggtctgaaagatagaacacgatgtggcacatatctttaatgccaggatggacagtcagggacgagtggggctctcggagttcaagcaacatcagcctgatgtgtgtaataggctccaactgtgctcaagagatatgtattcatctataaaaatctatgtgtatgtaagaggagcggtgaaacccattactctacatactaatttaaaattaacttttaaaaggagagggctggagatatgactcaacagttacagcatgtactgctcttgcagagaacccaagtttggttcatagcacccaatgtcaggtgactcacaactgcctgtaactccagctccaagaacataagaggcctgtggtctctatgggcacctgcacccatatgcccgtactcacacacggagacacagacacagacccagacagacagacacacacacacacacacacacacacacacacacacttataaaaataaaatctttttaaattgataaaaagaatatatatgattaacatgttcatttttactactgaaaacaatatttttatttatttcagtttgcaatcatatgtgccaatagatagataatagatacttgatttatatatatcagctttatctccttcaggttcactcttgtgctattttttttttttgctactgtaataaaacacatgcattgatacttcttaaagcaaaagtttacttagctgcaaatcctggaggtgcttcattggtttctggttagggtcttactgatatcacatgatgggaacacatgagagaggtcacatgatgatgaaattgagctgagaacaccaaacccagtctgctctgacagtgaccaatttagttccaaaggctcctgaactcactccagcatagttactaatctgttccaatggttatagaccaataacctaatcacctatcattacccactgctattatactgaggaacaagcctccaacactagagtcattgagaggcatggttactttgcttcttgctgtgaccaaatgcttgtcaagaagcaatgtaaggcaggaaggatttgttgtggctcacagtttgctgggatacagctcatgagggaagagaagggaaggtgtggctttagggagtggcctgtggttatgatggtaagagctgacagcacagtctgctcacattttggagggccaacccagaagcagatggtgacttgggtaggagtcagagtcagggtacagccctcaaagcctgcacttgcactatgtgcagaatcccacttccttaagcaagactccactccccagtttcccccgccaatgctacttagctggagactaagtgaatagcaggatcaagatttagtaggatttttttttaatttatttattagttctagttagggaacaagcttgtttcacatgtaagtcccttctccctctccctcccctcaccccatccctcttcccccacccccaccctactccccatcccatccacccaccactccccaggcaggatagggccctcaacgggggctctgcaaagtccaccaaatcttcctgtgctggttctgggcccttccccatgtgtccagggccagagtgtaacgcttcacgtgggatgggctctcaaagtcccttcttgcaccagggaaaaatgatttagtaggattttaatagaattcctgagattttatatgtttaaaaccatgctctatggttttctaatgtgaatatttttgcttcttttttactggcccttaagactattaaactgggtgggtgagagtagactttctttccctgccttgacctggagcagaaacattcagtctttcactaaagagtgtgatgctaaaggtttggggaacccatctctctctctgaactatttcctgagcagtagtctatcagattctcagtctttcccaggtgagtcagccattgttgaagtgcccagaccacattctgtaaatcactcttaaaaaatcccttttctgttcctttagagtagtggttctcaaccagtggtcccaactcctttggctcaaaggctttggaggtctaatgaccctttgacaggggtagcatgtcggatatctacattactattcataacagcagcaaaatcacagttatgaagtagcaatgaaatcattttatggttgggggtcagcataacactagggactgtattaaagggcattgggaaggttgagaaccactgccctggagagcctcattgcttctgctctgtcaccacacacctaagtcattattgctcagatacacaaaggctgccacagacaacagcaagcttgtgagcggggctctttttgatcaaaactttatttgtatagacaaacaactgacctgccagccatagctcaccagctccttctctggaacaatacccttgcccatttgttccctacagattgactttttcaggactccaagcttggtgtcatatttaatcaccccaattctgaattaagctaattgtattcttaagatgatatgtaatgtgtttctttatctctgtgttgagacattaagcattttggagcaaggtaggactactaaatcttgaaggactgtcactaaagttaatgtgactgagtgttgaacgtgaattatctattcagctgtctatcatccatttgccaagtgcattgttgcaccctctgctatgcatgttggtcaatgatcgaagagacatgtcatatgatctaacttgcccttgtagtgaggtaagcccaccagagatcaccacctggacattcagctaaaaagaaagactttattgctcaccagcaatagtacagggaacttccccaagtcatgcagaccagagtcctatagacctttgtcttgtaatgcaaaaccacagcctggctgtcatacctcagttaccaagaagcagaactattgaaggcaaaaagcaaggttagtacatttaaggtcttcctggaactatggaccacgtctttgatgaattaggtctttgttctggttttggcaggtattagggttttaaggtcagagcagtgcctcaacatggcatcagttgcgctcaggtgtggggcttgttacatcttcagtacactgaggcagggatggtcgggtgtcacaaaatcatggtgctcattgtatctagaccactttttagggtacaggttttctagctctgtgggctagaaaggacattgtaaacaagtatgataaaagtcagatccctagagaggtagaccggcctccgaggccaagcttgggtcagtaagccctttgctttcaagaagaaaagcatactggcttcagggtctgtggtgacttaaaaatgtgtccttaaattccttgtgacatctgccttctaaaggtaaggctaactcttcctgtatatgagctggatttcagctgcttctaatgtctgtagaggaagaccagatcataaaaagcaaagcagcatccccctttctctctctaaagcctccacctctgcaggaaatcagacatcatgtgaagacatcccaatgaaggtctacctggaatggaatggagactcctcaccagccagcatcaacttgccaactgtgtgagtatcttcaggctgctatgacaaacacagccagactggcggcttttttccagttctgaagtctgagaagagcataattaaggtgctagaaacttcaatatctggtcagaacttccttcctggaccacagatggatgactttatgtcttcatataataggagaggtgaaggagctcccaccctcatgacctgatacctttcaaaggtgatagtctgatccatatgtcatcacgttgtagattagagtccaataagtgaaattatggaggaatacactgagtcaaagcatcttggaagcaggcctctggccccactcacaccttcagacaaccacagtcttggctgacatctctcacaccctcatgaactaactacacagacaagcagcccctgaattcctgaaatgcgagagataacagagcctacctccttaaggccttctttggggagcaattttcactcaacaatagctagataagggggactttgcaccctgttggatcacatggagagcttcacccctccatttgtggcatctaacttgagacaacacaagcagaagctctcctcccttcctgctgggcacatgtgtctctctgatggctgctgacctcatagagaaattcccatgcaaaacttagcactgaacccctaaagaacgacaacctgggacacccacccccagggcgaactacatttggagatgacgccactgcctgtccctccccacagaagatccttttgagacttctgtctgaatgtgaggcagctgggctgccacactacttgctagaggaacagctttccccatgcagccaacagcacatgtggctgtgcaagctgcaatcttttttccattaacaccatgttccattgaaaacggaggactggccaagattccaaaaacactaaagtggtggattgttgccaaaatactccaattgattcaatgggacctttagggaaaagttagatattaggacctcactagcaaaagctagagaaaattttaagaaggggaggcatcctatatttccctatggtttgattttcatttggtttctatataaattagaatataaatatacattagagtggctttgcttgcatcgggaaagatttagactctagtcttttaaacattgtactataacttaataaacaaaagtagactatcaacaagcagttcataggacaacagagtcaaacagcttttaacactgaaaaagatgctcagtctcatggtagttaaagaattgtaaattaaaactctcttgaattctggcctcttgatggtaaaattggcagaaacttgaagccatgagaaagctagcatttgtccatgtttctagtaaagatacaaaaacggccctcatggggctggagaggcagctcagcagttaagagcactggctgctcttccagaggacctgagttcaattcccagcacccacatggtgactcatgaccatctataatatgatatgatgccctcttctggcatgcaggtatatgtgcagagcacccatacataaactataaataaaatttaaaaattatttttaaaaaatatggccctcagcttccaagagtactagatgttcttgaagaggacctgagtttggttcccagcaccccatggtggctcctaaactataactccagttcccagggattcaacaccctcttctgatctccacaagaacccacatacacaaggtccacatacaccttcaataagtaaatctttttaaacaatgcctgtctcaaggagaagttgaggacatctaacagaatgatatgtgcattgaccctttaagataacaacagtgcttctagagatttacactgaatccacacttccccaaatgaaacaacatacatgtgaggctgtttgtgctgacactgtgtgtaatataaaagatcagaaacaacttcaatgcattagagtatcatggaaaagtcatggaatagtcacacaatggggtgactatactgtcatgcaaaagaaacaggaatgtatgtggaatgatggctaggagatactgccagattaaaaagaaaatttcagagcaatgtttatgtatacatgtgtgtttccaaatgaaacacagaaaaaaaaatccatgtgaaagtaataaaatactgatggcctattggagggcaggtgtgggacagagaagggaacagccaaagactacatgtcctcctctctgtgtagtataaaatgaatccaaaccccaaaattaaccttaaattttaatataaataggaccaaatgactctaattgtatgtcatattagtaaaatggctctgcaggtgcttgtcaccaagtctggccatctgagtttgatcctcaagacatcatggggaccatccccaggtccacatggcaggaagagagaagcaattagagcaagctgtccctggcctctgtggggcatgatagacacagccacacccatccacacacctccacacagacagaatgtgtgtgtgtgtgtgtgtgtgtgtgtgtgtgtgtgtgtgtgtgtgtgtgtgtgttcaaaggaaacaggatgtttagacattaaaaagcaaagaagaaataatgactgaaatgctttggggtatactacttttactatatgaatgtagtaagatatttgttctttctctctctctctcacacacacacagagtgctctctctctctctctctcacacacacacacacagagagagagagggagagagagagagagagagagagagagagagagaaacagaggattcctaattaggaaaagcttcatctccatcctcttcctccactttgctcctcccagggaacttgagctggctgcagcatgcttgatactccaggaatgccaggtatgcgagatcaatcccaggagggcttctgggcaaccatgcatggttcccctcaagtcagctcacctcctcctgcccaccacctccgcagtgtgcttcatgacttcaccctgctcattgctgttgtgtgggaggcccaggatgagggtacagccagcaaaacccaacccagctcatcaggaaaactcactggcctgattcatcagagtctgctggggacagacaggaagaaccctgcctggggcctttccatgctgtgttgaacatgggcagcctcaagctgttttcacttgacaaacatcatgggtacccattgatctagctcttggtctcctaagagacacacaagcaaagataaaatgacacaccctccttaggagatgagcccaggatttcctacccgggaggctgaaacaaggagatagtgggaagcctgcagcaacgataggggccacctctgaccccacagacctcccccccacctcaaggtccctcagcaccagctgggaaatgtaagcatggactccccagaagccggagaaggcagctggaggcagatgtctctgctgtttctctgtggagtcctgtgtccagcatttcctaggtgataaacatggcttgtctagaagtttggattcagtggatggaaggacttcacatccagcagctgttctagctggttcttgccatccgagaaattgggggaccactgtgcagactgctttcgttttagtaccaaaggtatcttgtctcctgttctgtcccttcctgaggtccactcagaagagacaggcccctttggcctgagccccctgtgccacacacactcagcaaaacaatggtcacgcccacaggaggacatcaagagaccaccataactcttcctgtctcattcaccaccccacttacttgcctcacccagaggtgactctccttctctgagcacctgcttcccttggcttctcccattcttcttccctcagttgttgaaatgccaaagggaattacgagctaaaatttgcagaattgattggctggaatccatttcagcagtcccagaggaaggcaatgagctcacaagaagctctacagaggcagcatggtggtgcttcccaccatgagtgggtcattccaccctgatttctccaacctcattgtaatttttttgtagtgttttctcccagaaccataagcatagactctgaagtaagatctctgtgttagttgttttcattttgtaacccgaggcaggcttccttaaaaggaaaagaggtttatttagctcacagtctggggacctaagcatggtccaggctctagtgaggcccctactgatttcattgtgacagattgtctatgtttttctctgtgcatctgtgtctggtctctgtcccacctcttagaaagccaccaaaattcaatcatgcagctccaccctgatggccttactaaatctagtgccttcctaggcctggccttcacacattttgaagttacagtatgtccttaccctttaaaaatggtgtgtgtactttatttacttatatttttaattatatatgtgcatgtataatgtaattatcggcagggatgcacgtgtactttcatgtatatggatggaagtcagagaacagcccttaggaactggctttctaactctaccatgcagattcagggagctaaattcaggtcctaacctcatcggcaagcccctttacccactgaaccatcttgccagccccagttcctacctcccaaagccattaatccatggcttacaggagtaagctcctggctgaatttggaaagcaaaccatagaaccctgtatgcttgttcggctggtgatgcttggtgtacaaaatcaagtacatgtggaaaagtacacgtcccttctgacagaatcatcctagctctaaaatgtcccaggtatcacccctctcctccagctctgtgacctgcagcatgcaacctctttgggactaattgtactccaagtttgcccctctcctcagccaatgtcctgcagctgtggcacccccagcattactggagtcactaccaacacccaggctttaccttcacaacatcacacaatggcctcctgaggcctccttgtaggtatccagaccccaccacacattttctggcttcagttgcactctgaaactatggagcaagtctcccgtgcccctcgagcctatatctttcacacctccagagagagctgcacatggaccatgctgctgagtgctgctccagcttgcaatggaggctctcgagtatgcagtttcacccccaggacagtttccattcccccagggcagtgcaggagatgaatctctggtgatgagtctagtttctcagttacagatgaaaaactggtttctcagttacagctactcctgaaaggatgctgccttgaaacatccttgtaaataaatccatcatctttaaatctgtctttgctcaggttcttaagatggaagcacaatgaagccatactcttggccaaaattcctcaatggccccttgcctagctgctgggagaggccctgttccctctgaaaggttgacaggcaggcctccagtctgcatttctctcagcacctttctttcaagctcccaccaggagctggagagatggctcagaggtaaagagcactggctgctcttccagaggtcctgagttcaattcccagcacttacattgtggctcaagctctcaccaggagctggagagatggctcagaggttaagagcaatggctgctcttccagaggacccaagttgaattcccagcaacaacatggtgggtcaagcttgttaagctctgctccagcacaccaaggctttcctgacactgattatcaagttctgctacattccaggcacaaaacagtttgagaggccaaagaatcacatgttcagattcctcacctcatatcaacttctgtcttagcttcttttcctgtgataaaattgtctcatgaaagtaactgaagggagaaagggtgtatttagcttatagttccactcgctgcggcaggaggcagcagctgctgatcatttcatccatagccaggaaacagatggtgatgtgtgtccatgttcagctcactctcaccctttcattccattcagagcccagcccaggaaccgatgccatccatattcccggtgagtgttcttacctagattgacccaattaagacaatccctcacagacaggcccacaggccaagcttatctagacagcccctcattaagagccccttctcaggtgactccagatcctgccaagttgacaattgaaatcatccatcaccatactcaacatcattagtcgttaggaaaatgcaaatcaaagccacaatgaaatgctactgtatgtcatgtaggaaaagttgtaatttattaaagaaaacaagtgttggtaaggatatagaaaagctcaaatacttgctagcagtaacatgaagtggtatttcagtggataaatggataaacataccatggtatatccatacctctgtgtgtgtgtgtgtgtgtgtgtgtgtgtgtgtgtgcgcgcgcgcgcgcgcgcgcgcgcgcgcgtgtcccttgtctataaactacccgcccggcaagccctgcaagccagggagaggtatggaatccataccataaaaaaaggaatgaagtagtgatatatgctacaacatggataaacctcaaaatatactaaacaaaaacagtgaaatataggagattgtattgtatgaaatatccaaagcaggtaaattcagaatgtctggaagcagcttgggagttgtgggaagctgggagtgaggatgtgatggggaataatgggaattttggcttagtgagcatgggcctttgttctaaggaactggaaggaagtggtggttaggaaaatgtagggtatggactaaatgttaatgagttttcactttaaagcagttcatttgggctagagatacagtcattgctagatcacttgcataacatgcacaaggcccaggggtcagtcctctgcaccagaaatatatatactcactatatatgtagatatcattttgccacaaaatgatctattttgtagtgcaaatattggcccaattaaaaaaggggggaaggagagtagatagttctgaattgcctgaagccctgagtaggttcttggaaggtgtcacctggatccgaaccttaacaaagaaatcaaaaaggaaggacatggctgctcctaggtatggtggaggagaaagtttactgtagacaaaatgcagaacatagtcaaaggcggagacatctgggagagtccagagtgaatatgaccctgatccaggccatgtgaggagtgcagggaggaggatggaggagagagccaggaaaataaaggtagaccaaagggcgggcaactaaaatggttgattctgtagggaagggcaggccagcctctggggtgcagagttcagggtagagcagctgtgccagccatagcctgtagggactgagggatgctgggagaacctggcagccaggtccacttttatttgttaaataagcacctcagttagctgtttgtcccaggtttgagaaccaacatctgtgacattatccaacccagctctccctccagccattgcagatctgcagtaacatgtgcacatatggcccacctccgctggaaggtcatagcctctggcttcattcccccagccattgaagaccacaagggttgacaatagatctccataaccacaggtcagacctacttctgacccttcctaaccgtttgcttagctttacaaccacataaaagcaaagcacttggtcacaaatccaactttgagccacccaatagactctggatgataaatgaaaactcacaactgaagtaattctatctagcagtttcagcttggccattttaagcaaatagccacagaaggaagtaacgataatctaccctttgttctaattttaaaatgtgaataattaactttccaggaggaagaataacacagacttttaagagtggttcaacctaataaatgtccaatttgaaaacagcttagaactgctggccctaacagccaccttgatttattacagtggtaattcacatgtgaccagccagaaccgcagatgaactgccctgcccagcacctgtactctgtggttgggcacttgaatgctagataacactgaggcttgcagggctggtagtttatagagaaaggacacgcgcgcgcgcacgcacacgtccacatacacacaaacacagagagagagagagagagagacagagacagagacagagagacagagagaaagagagagaaagcaggcatggtggcttattcctataatcccagaactctgaaggctgaggcgtgaggagcgtaagttcgaagctagcctgggcaacatagcaaaatcctgtttcaaaaacaaagcagaacagagtctccagggaattcacatcccaatttattcagaggcttcagactgtccatgcgttatgaggcctcaaagctcctaaagaagggagaggaaatgggaaaagagcaagagggaaagaggagagggatgaggaggaaacatcataaagaaatttggacaccaatctattccttggtttcagaagtgaataaccctggagacaactaaacattaaccaattctgactggcctctggcatctcaggactctaataggagcctggctttaactaaccagctaaaggcagagtggggcaagtggctcagtcagtgaggtgtttgttctgaaggcatgaggacctgaattcaacaccaggacctgcagaagctgctggtggtggcacacttggaaccccaggtctgaggaagtgcagacagacagctcctgaggcttactggccagccagcctacctacattatgagttccagaccaatgagagaccttgtctcgaaacaacacagggtacagacagctcctgaggagcaatgtccaaggttgatcttgggtgggcgtgtgtgtgtgtgtgcacgcgcgcgcgcacacacacacacacacacacac

SEQ ID NO: 38 - DNA, 23 bp, Unknown
  source: /note="Description of Unknown: CPEB2A Target Sequence"
aggggcaacacagtctgctgcta

SEQ ID NO: 39 - DNA, 23 bp, Unknown
  source: /note="Description of Unknown: CPEB2B Target Sequence"
aagctgtattagctttgctgcta

SEQ ID NO: 40 - DNA, 22 bp, Unknown
  source: /note="Description of Unknown: SRPR-alpha Target Sequence"
taatcatgttacaatcactgcc

SEQ ID NO: 41 - DNA, 23 bp, Unknown
  source: /note="Description of Unknown: CNTFR Target Sequence"
caccatcagattataagctcctg

SEQ ID NO: 42 - DNA, 21 bp, Unknown
  source: /note="Description of Unknown: EIF3A Target Sequence"
cagtctaaattgaattcttta

SEQ ID NO: 43 - DNA, 20 bp, Artificial Sequence
  source: /note="Description of Artificial Sequence: Synthetic primer"
tttgggacgtttcctgagtc

SEQ ID NO: 44 - DNA, 20 bp, Artificial Sequence
  source: /note="Description of Artificial Sequence: Synthetic primer"
ctcatccaccaccttgttcc

SEQ ID NO: 45 - DNA, 20 bp, Artificial Sequence
  source: /note="Description of Artificial Sequence: Synthetic primer"
gcaagaccggatgttcaaat

SEQ ID NO: 46 - DNA, 20 bp, Artificial Sequence
  source: /note="Description of Artificial Sequence: Synthetic primer"
cctcaaccacgtgatccttt

SEQ ID NO: 47 - DNA, 20 bp, Artificial Sequence
  source: /note="Description of Artificial Sequence: Synthetic primer"
ctgcagacaatgcgagagaa

SEQ ID NO: 48 - DNA, 20 bp, Artificial Sequence
  source: /note="Description of Artificial Sequence: Synthetic primer"
cgacagaaacgggttgagat

SEQ ID NO: 49 - DNA, 20 bp, Artificial Sequence
  source: /note="Description of Artificial Sequence: Synthetic primer"
gagtgacattcgggaccagt

SEQ ID NO: 50 - DNA, 20 bp, Artificial Sequence
  source: /note="Description of Artificial Sequence: Synthetic primer"
gtctctgccattgaggtggt

SEQ ID NO: 51 - DNA, 20 bp, Artificial Sequence
  source: /note="Description of Artificial Sequence: Synthetic primer"
gaggacctgtggcatgtttg

SEQ ID NO: 52 - DNA, 20 bp, Artificial Sequence
  source: /note="Description of Artificial Sequence: Synthetic primer"
cattttaggacggcgggtag

SEQ ID NO: 53 - DNA, 20 bp, Artificial Sequence
  source: /note="Description of Artificial Sequence: Synthetic primer"
gaagtcctgtggtgagctgt

SEQ ID NO: 54 - DNA, 20 bp, Artificial Sequence
  source: /note="Description of Artificial Sequence: Synthetic primer"
tggccagaaaatccagcagg

SEQ ID NO: 55 - DNA, 20 bp, Artificial Sequence
  source: /note="Description of Artificial Sequence: Synthetic primer"
ctggaaggtgctgaggtacg

SEQ ID NO: 56 - DNA, 20 bp, Artificial Sequence
  source: /note="Description of Artificial Sequence: Synthetic primer"
ctcagctcctcggtcacatc

SEQ ID NO: 57 - DNA, 20 bp, Artificial Sequence
  source: /note="Description of Artificial Sequence: Synthetic primer"
ctttggtagctgccttccca

SEQ ID NO: 58 - DNA, 20 bp, Artificial Sequence
  source: /note="Description of Artificial Sequence: Synthetic primer"
gtatcctaacgcccagaccg

SEQ ID NO: 59 - DNA, 20 bp, Artificial Sequence
  source: /note="Description of Artificial Sequence: Synthetic primer"
taataaactccccgggcagc

SEQ ID NO: 60 - DNA, 18 bp, Artificial Sequence
  source: /note="Description of Artificial Sequence: Synthetic primer"
acaacgcgtggacttctc

SEQ ID NO: 61 - DNA, 20 bp, Artificial Sequence
  source: /note="Description of Artificial Sequence: Synthetic primer"
cactcttccgtggtctggtg

SEQ ID NO: 62 - DNA, 19 bp, Artificial Sequence
  source: /note="Description of Artificial Sequence: Synthetic primer"
gttgtctgacgtcgcacac

SEQ ID NO: 63 - DNA, 20 bp, Artificial Sequence
  source: /note="Description of Artificial Sequence: Synthetic primer"
tttccaagggttgagtcgca

SEQ ID NO: 64 - DNA, 20 bp, Artificial Sequence
  source: /note="Description of Artificial Sequence: Synthetic primer"
gaatttgcaagcggggtctt

SEQ ID NO: 65 - DNA, 20 bp, Artificial Sequence
  source: /note="Description of Artificial Sequence: Synthetic primer"
cgacatccgcaaagacctct

SEQ ID NO: 66 - DNA, 21 bp, Artificial Sequence
  source: /note="Description of Artificial Sequence: Synthetic primer"
aggatgcttagctcaccttga

SEQ ID NO: 67 - DNA, 29 bp, Artificial Sequence
  source: /note="Description of Artificial Sequence: Synthetic primer"
ggagttcaaagccagcttataccaacatg

SEQ ID NO: 68 - DNA, 27 bp, Artificial Sequence
  source: /note="Description of Artificial Sequence: Synthetic primer"
gctaaagttggtatggcagcctgcacc

SEQ ID NO: 69 - DNA, 23 bp, Artificial Sequence
  source: /note="Description of Artificial Sequence: Synthetic primer"
ggatcactctcggcatggacgag

SEQ ID NO: 70 - DNA, 25 bp, Artificial Sequence
  source: /note="Description of Artificial Sequence: Synthetic primer"
cctcttcttcagccacagtcacttc

SEQ ID NO: 71 - DNA, 20 bp, Artificial Sequence
  source: /note="Description of Artificial Sequence: Synthetic primer"
gcagcacgaacaagagtcac

SEQ ID NO: 72 - DNA, 20 bp, Artificial Sequence
  source: /note="Description of Artificial Sequence: Synthetic primer"
gaacctgcgtgcaatccatc

SEQ ID NO: 73 - DNA, 25 bp, Artificial Sequence
  source: /note="Description of Artificial Sequence: Synthetic primer"
ggacatatctgggtgaagggagctg

SEQ ID NO: 74 - DNA, 30 bp, Artificial Sequence
  source: /note="Description of Artificial Sequence: Synthetic primer"
cagccgcacggtaggcttgtactcggtcat
